United States Patent 12,576,115 (BACTERIAL COMPOSITIONS FOR TREATING AND PREVENTING HALITOSIS) - sequence listing, part 4

SEQ ID NO: 20 - DNA, 7236723 bp, unidentified (residues 1-1,809,181 of 7,236,723)
  source 1..7236723: mol_type = genomic DNA; note = Lactiplantibacillus plantarum 2
taaggggcgggtttttttataaaaacacttgcgccggccccggtttcgggatatgctcttgtagctctttcgctttctgggagaaagcgtttttttaattgccgccgctttattgactcgcccatgccgcgcctttatattcttattaagaggaaaacttcaccaagagaatcggcgtcagaagccgggcagctttcgatacagtgcaatgatattgaaagggagatgagcggtgtggaacatgtacaaaaaaatcagtcactcaaacaaaaggataaagagctgatttggcacgcgatgaaaggggcggagccggatgacagcataatcgttcaaaaaggggaaggcgcctgggttacggacattgacggcagacggtatttggacggcatgtcaggcctgtggtgcgtcaatatcggatacgggagaaaggagcttgccgatgcggcttacagccaattgaaggagcttccttattatccgctgacccaaagccatcaacccgcgattgagcttgcggaaaaactgaatgaatggctcggcggcgattatgtgatcttcttttccaacagcggatcggaagcaaatgaaaccgcgttcaaaattgcccgccaataccacattgaaaacggcgatcacagccgcttcaaattcatctcccggtacagaggctatcacggcaatacgatgggggcgctcgccgctaccggccaggcgcagagaaaatataaatatgagccgctctcacaagggtttttgcatgcggcgccgcctgatctttatcggaatcccggagatgccgtcacattggaaagcgcgcatgacatcgaccggatcatgacgtgggaattaagcgaaacgattgccggcgttattatggaaccgattattactggcggagggatactgatgcccccggacgggtatatggcaaaggtagaggacatttgccgccgccacggcgcgcttctgatcagtgatgaagtcatttgcggtttcggccgcacgggagagccgttcggatttcagcattacggcgtttcaccggacatcgtcacaatggcaaaaggcattacgagcgcttacctgccgctgtcggcaacggcagtaaaacgggagatttttgaggcgtattcgggcggtgagccgtacggccgcttccggcacgtgaatacattcggaggcaatccggcagcctgcgtcctggctttgaaaaacctgcaattgatggaggacgaaaatctgatcgcccgctcccgtgagcttggagaaaggctgctccgtgagcttgagccgctcagagaacatccggcggtcggagatgtacggggcaagggccttcttgccggcattgagctcgtcaaggacaaagtcacgaaggagcccgctgatgccgcccttgtgcagcacgtcatcaccgcgtgcagagaaaaaggcctgcttgtcgggaaaaatggcgatactgtagcgggatataataatgtcattcagctgtctccgcctttttgcctgtcggacgaggagctctctttcatcatttcgaccgtcaaggaaagcgtgctgagcattgatttttaatgtaaaggagtaaaacatgagttttcacaaccagcagattctaccggcaatccggaacatgaagcaattcgatgcatttttagaaagtccgttcttatacggcgtcattttagatatccacctcggtcaattaaaaggtgtcgtgaatgaagcaaaaaaacacggaaaacttctgatggttcacgtcgatttaattcacggcattaagcatgacgaatacggtgcggagtttatttgtcaggatatccggcccgcgggcatcatttcgacgagatcatcagtcatcgtcaaagcgaaacaaaagaaaatatacgcgatccagcgtctgtttctcttggatacgagcgccatggagaaaagcatggaattcgtcggaaagcataagcctgactttatcgaggttctcccgggcatcgttccgactttaattagagaaattaaagaaatgacggggattccgatttttgccggcggctttatccgcacggagcaggacgttgaaaacgccttgcaggcaggagccacggccgtgacgacttcagacaccgaactatgggctaaatatgaacattctatgacaaaaaaagattgacaccgcttacacccattgttacaatagacctaggttaatactatgtgatggagatccggagacccacaacagctctttacggaagcaataaagcgtaaagcggtttgttgtgggttttttattctctataactctgtcaaacctgctattttgtcatttaggaggaatgatgatgacagcattttggggagaagtaatcggtacaatgctgcttgttattttcggcggcggcgtttgtgcgggagtcaatttaaagaaatcgctttcataccaatccggatggattgttattgtattcggctggggattgggagtagccatggcggcatatgccgtcggcagcatcagcggcgcccacttgaatccggctttaacgataggccttgcgcttgaaggcagctttccttggaaagaggtccctgtttatattgcggggcagatgatcggagcaatgatcggtgcggttgttgtgtaccttcattatctgccgcattggaaggcgacggatgatccggccgctaaactgggcgttttctcgaccgacccgagtattcctcatacatttgggaatatgataagtgaagtcattggtacgtttgtgcttgtgctcggcattttggcaatcggagcgaatgaatttacaaaagggctgaacccgctgattgtcggattcctcattgttgccatcgggatttctcttggagggacgaccggatatgcgatcaaccctgcgcgggatttggggccgagaatcgctcacgcctttctgccgattccgaaaaaagggccgtcaaattggaaatatgcctggattcccgtagtcggtccgatcatgggcggtgcgttcggcggcgtattttacaatgctgcgtttaaaggaaatgtgacacctagcttttggtttgtaagcgttataatagttgtagtgcttttcatactctatatttataccaataaatctcaatcacggaaaatattatcaaattctgaatatatttaaaaaggagagcggcatcatggagacctatattttatcaattgaccaaggcacaacaagttcaagagcgattctttttaataaagaaggaaaaatcgtgcattccgctcaaaaggaattcacacagcatttccctcagccgggctgggtggagcacaatgcgaacgaaatctggggatcggtgctcgccgttatcgcgactgtgatctccgagtccggaatcagcgctgatcaaattgccggcatcggcatcacgaaccaaagggaaacgacggtcgtatgggataaagataccggaaagccggtatacaatgcgattgtgtggcaatcgagacaaacatccggcatttgcgaagagcttcgtgaaaaaggatataatgatacattcagagaaaaaacgggacttttgatcgacccttatttctcaggaacgaaagtcaaatggattcttgacaatgtagaaggcgcgcgggaaaaagcggaaaacggaaatcttctgttcggaacgattgattcatggctcatctggaaaatgtccggaggggcggcgcacgtaacggattattccaacgcttcaagaacgctgatgtttaagatccatgaattaaaatgggatgacgagctgcttgatattttaggcgtgccgaaatcaatgctgccggaagtgaaaccgtcttctcatgtgtacgcgaaaacggttgattatcatttcttcggtaaaaacattccgattgcgggagcggcgggagaccagcagtcagcgctgttcggccaggcgtgctttgaagaaggcatggggaaaaacacatacggcacaggctgctttatgctgatgaataccggagaaaaagccatcacttctgatcacggcctcctgacgacaatcgcctggggattagacggaaaagtcgagtatgcgctggaaggaagcatctttgtcgcaggttctgccatccaatggctgagagacggcatgcggatgttccaggattcaaaagaaagcgagacatacgcagagcgtgtggattccgctgacggtgtttatgtcgtgcccgctttcgtcggattaggcacaccgtactgggacagtgacgtgcgcggctcagttttcggcctgacacgcggaacgacgaaggagcattttatccgggctacgcttgaatctctcgcttatcaggcgaaagatgtacttgatgccatggaggctgattcaggcatctctttaaaaacattgcgtgtagacggcggagcggtaaaaaataacttcctcatgcagttccaaagtgacttgcttgatgtgccggtcgaacgtccggaaattaatgaaacgacggcgctcggtgccgcgtatttggccggaatcgctgtcggatactggaaggacagcactgaaatcgccgatcaatggaaccttgataagcaattcaaaccggaaatggaagatgaaaaacgcgatgaattgtacggcggatggaaaaaagcagtaaatgcagctatggcttttaaataagataaaaatgtggtatactgaaaacaagttaataggaacggtcctgagatgaggagagaccacagcaccaaagtgatgacatgcgctttggctgttgtggtctctttttctataccgtgacaacaaggaggaaacgtaatgatgaatcaccaattttcaagtttggaacgggatcatatgctggaagacatgactaaaaaaacatacgatctgtttattataggcggaggtattacgggtgccggtacggcgcttgacgcagcttcaaggggaatgaaagtcgctttgagcgaaatgcaggatttcgcggccggcacatcaagccgatccacaaagcttgtccacggcggtttgcgttatctgaagcaatttgaagtcaaaatggttgcagaagtcggtaaggaacgtgccatcgtgtacgaaaacggcccgcacgtcacgacgccggaatggatgctgctgccgtttcataaaggcggcacgttcggttcattctctacttctatcggcctgcgtgtgtatgactatttagcgggagtaaaaaaatcagagcgcagaagcatgctgtctgctaaagaaacgctgcaaaaagagccgctcgtcaaaaaagacggcttaaaaggcggaggctattatgtagagtaccggacggacgatgcgagactgacgattgaagtcatgaaagaagccgttaaattcggtgcggagcctgtcaactattctaaagtgaaagaactgctttatgaaaaaggaaaagttgtcggcgttttaattgaagatctgctgtcaggcaaggaatacaaagtgtacgccaaaaaaatcgtcaatgcgacaggtccgtgggtcgacgaactgagagaaaaagaccacagcaaaagcggaaaacatctccagcacacaaaaggggtccatctcgtattcgaccaatccgtattcccgcttaaacaggcggtgtactttgatacgccggacggccggatggtgttcgccattccgcgtgaaggaaaaacatatgtgggtacgaccgatacggtttacaaacaaaaacttgagcacccgcgcatgacggtgcaggatcgcgattatgtcgtcagctccatcaattatatgttcccggaactgaacattacggcggacgatattgaatcaagctgggccggcctcagaccgcttattcacgaagaagggaaagacccgtctgagatctcccgtaaagatgaaatctggacatctcaatcaggcctgattacgatcgccggaggaaaactgacgggctaccgtaaaatggctgagcacattgtcgatcttgtccgcgaccgcttgaaagaagagggcggccaggacttcggcggctgcaagacgaagacgatgccgatttccggtggacatgtcggcggctctaaaaacttcgagtcatttgtggaagcaaagacaaaagacggcttgaaaatcggtttatcacaggaaaccgctaagcagttagccatcagatacggctctaacgttgaaaatgtattcagccggattgaaggcctgaaagatgaagcggaaaaacgccagattccggttcacattctggcggaagcggcttacagcatcgaagaagaaatggctgcgacacctgccgatttcttcgtccgcagaacgggaagactgttcttcgacatcaaatgggtgcaaacatataaaacggccgtgattgattacatgagcgaccgattccaatggaatgacgcaacgaaagaaaaacacactgagtggttaaatacgctgctgcacgacgcggttgttccgctcgaacaataataaccggagggctgtgccgaaaaggcatgagcccttcttttatcttcttacataaagcatttggttaggttatcaagtgacacgggcagccgattcatattaaaatatggtcataagctgaaattataggaggacgaacatgagttggagtaagagctacgaacgctggaatcaggccgaacaattagattcagaattgaaaaaattattggcggacgcggaaggaaacgagcagctgctggaagattttttctacaaaaatcttgagttcggaacaggaggcatgagaggagaaatcgggccgggtacgaacaggatgaatatttacacggtccgcaaagcatccgccggacttgcggcgtatatcgcgaaacagggggaagacgcgaaaaaaagaggggttgcgatcgcatacgactcccgtcataaatctcctgagtttgcgatggaagctgcaaaaacccttgcttcccaaggcattcaaacatacgtatttgatgagctccgcccgacgcctgagctgtcttttgcggtgagaaagctgaacgcttatgccggtatcgtcgtgacagccagccataacccgcctgaatataacggatataaagtgtatggcgatgacggcgcacagctgccgccgaaagaagcggacatcgtcattgcggaagtgaatgccatagaaaatgaattaacgattcaagttgaagatgaacagtcgctgaaagaaaaaggtttgattaaaataatcggtgaagaaattgataaaccgtatactgaaaaactgacttccatctccgtacatcccgagctttcggatgaagtggatgtcagcgtcgtgttcactccgctgcacggcacggcaaataaaccggtacgccgcggtcttgaagcactcggttacaaaaacgtcaccgtcgtaaaggagcaagagctgccggacccggatttttcaaccgtcaaatcgccgaatccggaagagcacgcggcattcgaatatgccattaaactcggagaagaacaaaatgccgatattctcgtcgctacggacccggatgccgaccgtctcggcattgccgtaaaaaacagcgaaggcaagtacacagtgctgacgggaaaccagacaggcgcgcttttattgcattacctgctttccgagaagaaaaaacagggcacccttcctgaaaacggtgtcgtcatgaaaacgattgtcacgagcgaattgggccgcgccgtcgcttcatcgttcgggttagatacgattgacacgctgacaggcttcaaatttatcggtgaaaagatcaaagaatatgaaaaaacaggccaatacacgttccagttcgggtatgaagaaagctacggctacttaatcggcgatttcgcgcgtgacaaagacgcgatccaggctgcgctgttagccgtcgaggtatgcgccttttataaaaagcagggcatgtctctttatgacgcgctgctgtccatttttaaagaatacggttattaccgtgaaggtttgaagtcattgacgttaaaaggaaaacagggagcagagcagatttccgctatcctgacttcattccgaaacgatccgccgaagcagatggccggaaaacaaatcacgcaggctgaagactattcaacgggaaaacggactgtatttgccgatcatcgtgaagaagatattgatcttccgaagtcaaatgtcctgaaatatttccttgaagacggctcttggttctgccttcgtccatcgggaacggagccgaaagtgaagttctatttcgccgtgaagggaagttctttacaagacagcgaacagcgtcttgccgcattatctgaagccgtcatgaaaacggtggatggcatagtggaaaatacgaaataaacaacaaccgccggaagcgacatccggcggttttttttacgtctcatccgaaagtatgaggaaaattcatgctgaaaacaaaggaatatacagaaaagaattgatataatatggataattctgattggccggagtgagggaaattgacgaaaacgacggtagaaacgttaaaaacgttaaaagcgattgcggaaaccttaaaccaaagccacgatttaaaggaagcgcttgataaagtgctccgcgaactgctcagcctgaccgggctgcagacagggtggatttttctgattgagccggacgggtcttatacgctcgccgcatccgcttatttaccgccggctctcggtcagcgggaaaatgcactcatgtgcagcggggaatgctattgtctgaccaaattcagcaatggcggattgacaaaggccgtaaacataatgaattgtaaacggattgaatttgcggaacagacgacgaactgccgcgatacggagggcattacccatcatgcgaccgtaccgcttgaggacggcggccggaagttcggtttattaaacgtcgccgcaagtgaaaagacatttttcaacgaagaagaactgcatctgcttgaagcggttgcatttcaaatcggaacggcgatccagcggatgaaattggccgaatttgagcagcagaacgccctgttgatggaacgaagcagacttgcgcaagagctgcatgattccgtcaatcagatgctgttttctgtcagcttaacggcaaaagccgcaaagagctttacagatgatgatcggctccggcagatgattatgtttattcaagagctgtctcaggatgcgctaacagaaatgagggcgcttatttggcagctgaagccggaaagtttgacgaaagggctgtatgcgtcgatcaaaagctatgccgctctcatcggcctggaagccgtttgtgaaatggaggatgagctggagcttacagatgaacaggaacacgcgctttggcggatcgcccaggaagccttgaataactgtaaaaagcatgcgggaacggaccgggttatcatttccgccgttaaaaagccggattgcgctgagcttcacatcagcgaccgtggagcgggcttcagcgctgatgtgcatgctgtgctcccatcgctcggcgtggccggcatgaaagcgcgggctgaagcgatcggaggccgctttacactgcaatccgagcttggcgccggaacgaattgtgattgctgatgatcatcatgttgtccgcaaaggactgcgctatttcttcgccactcaggaagacattgaagttgtcggtgaggcgtccaccggtgctgaagcgcttcagcaagctgaaaagacggagccggacatcattctgatggatttatcaatgcctgatatggacggcatagaagcggcaaaaattgcggctgaacgatttccggacatcagtatcgtcgttttgacgagctattctgatcaggagcacgtcattcccgcccttaaagccggcgcaaaagcgtatcagctgaaagacgctcagcccgatgatttagtgaaaacgctccgggaagtgtattccggacgttaccggctgtcggcggatattgtgcctcacgtgctgacccatatggttcaggatgatcaggataaggaaaaatattatcagctgaccccccgtgaaaaagatgttcttcaagaaatagccaaaggaaaaagcaataaggaaattgcggcggcactgtttatttcagaaaaaacagtgaagacccacgtgtccaacctgctgtcaaagctgaatctttccgatcggacgcaggcggcattgtatgcggtaaaatataatgtttttggaaaggcggtaaaatcatgagcatattagtgatcagcggcacaccgagaaaaaacgggcggactagaattgccgcttcttatatcagagatcggtttcataccgattttattgatttgagcgaaagtgaactgccgctttataacggtgaagaagaacagaatgagctgccttcagtgcaaaagttaaggcagcaggtgaaaaagtcggcggccgtcgtcttattatctcccgagtatcacagcggcatgagcggcgctttaaaaaacaccatcgattttttaagcagcgatcactgggcatacaaaccggtggccatcattgccgcggcgggcggaggaaaaggaggcatgaacgcgctggcgaatatgcggacggtcatgcggggcgtctatgcaaatgtcatcccgaaacagctggtcttagacccgattcacatcgacatggagcgccggaccgtatctgaggatatggcggtcagcctgaaagccatgatcgaagagctgaatatgttcacaaacacaagaaatcccggcgtctgacgccgggattgttttatgtcagcatggctaattgatcttcataagcgagttctgtcgcatgatcaatatacccgagtagggaatacagctctttttcaagcaccgcatgatcgtattcgaaatgatacgcgtgcagaaagtgctcaatacgctttgataataaatcatcttttgtacgaaccatcaaaattaataaattgtcccattgagaccggtgtgtgtaatacaaggctttatcataatcggcatgatccatcttacgcttctcctttcaatgagaagttctccgttagtttatgccgccgaagcccggatgcaacgggggaaaacttggtgtccttatcattgcggcatagcaatatgagggagacataaaataaaaccgcatatccgtctcttctttggacacgctaagattgacaaaaaacgactcaggagaacataaagatgaaatcccttccatttgcgcttgccctctttttttgcggcattctcattgcctctatcgctgaaaaagggcatacagaacacctcgatccgtcagttgaaaaatgggaacagctcgcatggaaccagcttgaacgtgaatacaagggggccgagcttaccgattattcgtacatgggccgtacaaaagtgaaccgggaacagacgaaagacgtgtttcgcgtaacggtgcaaaccgcaaaagaaacgttttcatcccgtgctgaagtgtatttccatcccgtaacaaaacacgtgatcagcatcaatattttcagactgtaaaaaagctgcacagccttatgcggccgtacagcttatcagatatcagaagaaacgttttgcgccgaggtagcgctgtttccaataggagttgttcatgctggaaataacgacacccgaatcgttggcattaataaactggccgttcccgagataaataccgacgtgggaaggtccggctttataagttgagaaaaagacaaagtcaccgaccgccggctggctgactgatgtcatcgtattccagtagcctgcggctgaaagtctggatacagaagtgaccttattgagaacgtaataaatgaaaccgctgcagtcaaagcctctcggcgtcgtcccgccccatacatacggtacgcccagctgagcttttgcggcatcgatcattacattaatcttcgcgcttgttgaacctgtgccgcctgtgctgccggactgattcggtgtcgtgtttgtctgctgcccggtaatcgtcagtttctgtccgatttgaagaacatctgttttcagattgtttttctcgcggatctgctgggcggttacattgaacttttgggcgatcacccataaagaatccccgcttttcacggtatatgtagtggttttccctgtatttccggattggttcggagctgacggtgaagacgaagagccggaagaagacgttttggtcagcttcagcacttgtccgacccgcagcatgtctgacgtcagtttgttgatgcttctgatttgctgaaccgtcatattgtatgcgtttgcgattttccagagtgagtctccgctttttactgtataggaggacgtttgcgtctggtttttattttggtttgaattgtcttttgccggcgtgtttcccgaagaagacgttccttttgttttcaggacttggtttacgtagatcgtatccgtttttaagttgtttaatactttgagttccgcaatggtcatattgacgctgtttgcgatcttccatagggaatcgccgagttttactttataggtcccggaagatgatgactgatttttgctgctgtttgagctgctgccaggagcggtttttttctgatcggtgcttgaggaaactttccccgtcacttgcagcttctgtccggcgcggattaagtcgcttgtcagaccgttcaattttttcagttcctgtacggacattttaaaatcagatgcgatcagccacagcgagtctccgcttttcactgtataaacgcttttagtcgtgccgctgttctttgaagattgctttttgctgccggaatctgatttgccgttaggaatgttgagcgtctgcccgatagaaagaacggtggattttagatgattcgctgatgtaatggcatccacgcttgtattgtagttttgggcaagcttccataatgaatctccgcttttaaccttaatcgtttgtgcttctgccggtgttacagctaacgcagacccgacgatcgcagatgcagtcaaaccgaccgctaccttttttttcatagtgaatctcccttttcctgcgataatttttctatccccattcgttgcagccgcaaggtgaggatatcagtaatgataatctttatatcggcacttgtctgcaatcgtttatcatattaatagaaatagtccttttttcttatgccggcataaaaaaagaaggaatgcggacattccttcagcttctgagcagtctcataatctcctctttgtttttgaccagatcccttaacgtatatttgtctaaaacggccaggtaagcttgcagggcttcattcagaaggttctttaagttgcaggcgggagatatgatacagagattttttttggtgtcaaagcattctacgatgttaaagtcgtcttctgtatttcgaacgacttctccaatgtttatgtcttccggtgtcattcctaatcggattccgcctccccggccccggatcgtttcgacatatccgagctgtccgaggcggtaaatgactttcatgaggtggtttttagagatggaataagtatctgcgatttcttttatgttggaaagttcgtcggaatgtctggaagccaaaaaaattaaaacgcgtaaagaataatcggtatagttcgttaatttcatagaatgacctcgaaaaaagagattttgcttctgttacagtctatcatatatgaatttaaaataaaaaaaaaggaatttgtccctttaactcaaaaaaaaacgtgcgctccttctgagcacacgtttttttcgttaagacatcggcggcttacgatcgtcagccgattgatgtttttcaattttgcgatccaattttgcgagataacgggaggcgaattcttttccgccaagaccgaatgaaagtccgaaggcaagcgcgaaaccgcccagaatcagaataaacgcggcatttacgatcgtgtcggcgacaccgagctgatccagcgccataaagattgaaagagtgataatggtatatttcgcaagcggcgccaggaatctgaattcctttccgctcagcatgccggcaagcagcctgctgacgagctgtccggccaaaagcccgattccgagaataaatacagcggccagaacattaggcaggtaagcgataataccggttgcgataacgacgagaaattcgagatggacaagctgcagcgcctctgcggtaaagagcaggacgatgatgatctgaacaatcatgccgaccgtctgagaaagcgtcagcttcggggtacccgcctgttcaaagcccattttaccgagaagagagtcgaaaccgccccggtgcaagagtccggatacaatgctgttgacccattttccgatccagatgccggcgatgatcagcacgataccgatgatgatattagggagcattgtgaagaccgtgtgcagcatggctgacgccggttcagaaatacccgcgacatcaagccggtcaagcgcagaaatgatcaccggaatgaaaatcagcacgtagacaatcgttccgatgattgccgacaggcttgtatccttcagataaatagaaagccccatacgtgcggcaagcctttccgtgccgatactcgccagaaagtttgtgacgatatcacggacgagacgggcaacaagccagccgattaaaacaatcagcgccgcggcgaataatttcggtataaaggacaaaacgctttggatcatatttgtaaacggccctgatactccgctgatttggagagcagccaagacgccgggcaggaacaagagcaagacgaagtaaaaaacgattcgtgaagcggccgtaacggatctgctcatctccgcttcttcagaaaccattgtccattttctgagccggccgttttcagcaagtttcatgcccgcttttttgacgagatagctgaaaagcgaagcggccgcccagcccaacagcagaatcaggccggcttttaaaatgctcggcacagccgccgttatcgctgacagcatgctgacaaaaggcgaagccacggttgtcagatgcagaatgttaaagaatagaataaaaacgatgattaatgcgataaaataaatgactttactgatgactttttctgaggaatagcgcgccggctttttttcggcgaacagcctgtcgtcgatttttgttttttgcaggcctttgtatacggctttttcaatgattttggcaatgccccagccgataagcaggacgagcagtgcaatgatcagattcgggagtttgctgagatacgtcgtaagcatgtctgctgtattcaagtagaatcgctccttttctttttggggtatggtgtgtgttttacccacttacatataaagcaaacggggcggatgtgccgaaagttttcagccggaaaccggtctgttatttcatcttttgagaggaggggtcatacattataaataagtccaagtaggggggattcggttgaacgcggaggagacaaaaggtttacagcgggcaattgaggaaataaccgacattgccaagggtttcggccttgatttctacccgatgagatatgaaatttgcccggctgaaattatttatacattcggcgcgtacggcatgccgacgagattcagccactggagtttcggcaaacaatttcacaagatgaaactccattatgatctcggtttgagcaaaatttatgaacttgtcattaattccaacccttgctacgcttttttgctggacagcaattcgctgatccaaaataaattaattgtagcccatgttcttgcccattgtgattttttcaaacataactgccgctttcaaaatacgaaccgggacatggttgagagtatggcggctgcggcggagcggattaagcattatgaaagaatgcacgggataaaagaggtggagtcctttttagatgccattctggcgattcaggagcatatcgatccgtcgctcgtcaggccgaagctgctgtggagcgtcgatgacgaagaggaggacgaagaagaaaccgcgccatcgccttacgatgatttatggggaatggataagccgaagcaggtgaaaaagaaaaaagggaaaaaaccgtttccgccccggccggaaaaagatattctgctgtttatcgaagaacattcgcgggagcttgaaccgtggcagcgtgacattttaaccatgatgagagaagaaatgctgtatttctggccgcagctggaaacgaaaatcatgaacgaaggctgggcatcttattggcatcagcggattatccgcgagcttgacctgacttcagatgaagccatcgaatttgcgaagctgaacgcaggcgtcgttcagccgtcaaaaacgggaatcaacccgtattatttagggctgaaaatttttgaggacatcgaagagcgttatgacaacccgacagatgaaatgaaaaaatcaggagtaaagcccggttccggccgcgagaaaatgtttgaggtcagggaaattgaatcggatatatcatttatccgcaattatttgacgaaagatctcgtgatgcgtgaggatttgtatttattccaaaaacagggcagggactataaagtgatcgacaaagaatggaaggccgtgcgcgaccagctcgtgaacatgcgggtcaacgggggatttccttatctgaccgtcaatgacggggattacctgaagaataatgagctttatattaaacattggtatgagggaattgagcttgatctgaaatatttggagaaagtgctgccgtatctgtaccagctgtggggcaggagcgtgcacatcgaatctgttcttgaagacagagaagtgatgttttcgtatgacggcaaaggagtgcaccggagatatctgtaaaagaagaaaggatgcggggaaacccccgcatcctttttttattttccgtgtttcaggatgtgaaagatctttttggcctggtccgtgttgtttaaaagccccgtaaatgactctcttcccggaccgtatgcgtaaacgggaacttcttcgcccgtatgatcgccggttgtccagccgctgttggtttttgcattaaagagcttaatgatcgctttgtagacgctcttgtcagcgtcctgttttgcggccgtttcgatctgtttgatttcagcttttgaccatttcaggtctgtataacgcgcaagcacggaagatacggatttgcccgctttgatttggtcagccataaatgccggggtttttttggcggcaagaatcggttcaacatgccagtttttatcgtcattcgcgccgatcgtcaatccgccggtggtatgatcggccgtggcaacgacaagcgtatgtttgtcctttttggcaaatgcgatcgctgctttatacgctttttcaaaatccttcatttcgctcattgcgccgactatatcattgtcatgtcccgcccagtcaatttggctgccttcgaccattaagaaaaacccttttttattcttgttcagcctgtcgatcgctgccgttgtcatgtcttctaatgaagggacggcgtttgagcggtcgattgctttgtcgagtccgccatcggcaaacaggccgagaatcttcttgttacgatcctttttgagctcctgttttgatgtaacgtagctgtatcccgcttttttgaaatcctttgttacattgcggtctttacggataaagtttgatttgccgcctccgaggagcacatcgactttctgttttccgttgatgcggtcatcaaagtagctgcttgcgatgtcatccatattttttctggatttgttatgggctccgaatgccgcaggagtggcgtgggcaatctccgaagttgcgacaagtccggtggatttgcctctttgtttcgcttcttcgaggacggattttacccgctttccttttttatcgactccgatcgccgcgttatacgttttcacgcctgtggccattgccgtgcctgccgccgcggaatcggtaatattggaatcaggatcgtcagggtaagtcatcatcataccggtgagattggggtcgaatgccgtcagtttcatgccatccgaaggctttcctttgttaatgaccgaacggtaggcgttcatatagggagcgcccattccgtcgccgaccatgaagatgacgtttctgatctcgtttttgtcaggctgtttttttgccgcagcctgttcggagtgctgaagccccgcgcccgcaatcagaccggctgtcagcacggatacggctgccgccggcagaagttttgatcgaacctgtttaaatagactcattctcactcgtcctcctttaatcttgtctgcatgtctaatggtaggggatgtttgtaaagagcgcctgttcctcctgtaaatttcaggtgaaacattgttagaaatgtaaattccggtgtaacttatgttttcaagaaagagtgaaaaccattcacttttttgaaaaagacgaggatttttttaacaaggggttatttggaaaataaactgctttgtttttccaaaatacgaggatcacaggaaaaaaacatgacaaattgactcatttttcgtcacgtttgaaatcaaattgaaatatttaatacccttaaaaactttttttaaaaacgaattagtaagaaatttgtcacgggaagtcaagtctatttctagtggaaattgaaccttataataggaaacagataaaaactttaaaaaagagacacataaaatagatagaatcattcggggaggaaaacatgaaaaagcaacttgttacagcaacaacggcagtggttttggggacgactttgtttgcgggcgcggcatctgcgcaaacgattaaggtaaaaaaaggcgatacattatggggactttcaaatcggtacggaacgtcaattaattccattaaatctgagaacaaattaaaatcggatatcatttacatcggccagacgctttcgatcaacggtaaatcatcttcaggttcaaattcgggcagcaagtcatcatcgtctacatataaagtcgtaaaaggcgacagcctttggaaaattgcgaataaatataaaatgacggtaaaccaattaaaaagtttaaacggtttaaaaacggacctgatccgcatcggacaagttcttaaagtaaagggatcaacttccggttcaacgtcttcaggatcttcgtcatcaaagcagccttcatccagccataatgctgcacagacgagcctgaatgtaaacaagctgatttctgatgcgcaatctttaatcggcacgccgtatgtatggggcggaacaacgacttccggctttgactgcagcggatttatctggtacctgttaaacaaacagacgagtgtcggcagaacaagcactgcgggatactggagctcaatgaagagcgtgtccagcccgtcaagaggagacttcgtcttctttacaacatatcaggccggcccttcacacatgggtgtgtacatcggaaacaacaagttcatccatgccggttctgacggcgtcacaacaagtgatctgaataacagctactggaaacctcgctaccttggcgcgaaaagattctagcagcgatagaaacccgttcatcagaacgggttttttatttagacgggacagagctccatttgtttcacctaaaatgaaaatgtgataaaaaatctaaaaaggttttctttttttcattttcatagagggcgatggcgtacgcgcccgcgctcggcatctgggcgaattcgcacggaatttcaatcatgctgcctgcggcgagttcggcccgtaccgctgacagcggcagaaatgagacacccagcccctctttaataaatcgtttcgtaatatgcgtctgtgtcaccttcattgtcctgacgaaagggaactgtattctgacctggcggagcaaatcatcccaatagtcagggtggttatgggtcaaaagcagatattgtccgaacaggtctttcacttcatccgccttccctgtcccgggttttcggccgggcggcgcgacgaggacaacggggtcattgtacagggggcggcaagtgagggaagatgattgcacctttaagcagctcagtccgatatcggctgagccgtttctgatttgagaggcgatttcttccgattcgaaaatggtgaccgtcatttcggtttctttattgtcctctgtataacgcttcatgacagacgggagaacggtgtcggcgataagcggcgaaacagcgagtgtcagtgtgtgcgagtagccctggcgcaccctgtgcagctccgccatgctgttttcatagtcttccaaaagcctcatggcaaacggcacgtatgcttttccttcttccgtcaattgtattttccggccgcttcgctgaaacagcttgcagctgatttctttctctaataattttatatgaacggtgacggtcggctgagataaaaaaagcgtttccgccgtttttctgaaattctcatattttgccgcggtgacgaaggtgtgaagccatttaaaatccatagatgcactcctctgattaaaagttttaattaattcccttaaaaatattcattattttttaaatattatatttactataataacagaaagaggataagggggaatgaaattgatttatcgtggattgaaagggattacttgtgcagaaacggctatcagccacattgacggagaaaaggggcatttaatatatcgcggctatgatgcgaaggatatcgcgctgcaatccagttttgaagaagcggcgtatctcattttgaacggggcgcttcctgatgagcggcaattgcttgcgtttcaggaagaacttgcagccgagcgcgggcttccgaaacatttgatcggcttactggaaacgcttccggatgaaatggacgacatggcggtgctgagaacggctgtttcaggtttgggcacagattcatttacatatccgcccaagccggaagaagcgattaaactgattgccgtcacaccgacgattattgcgtacagataccgccgtaaacaagggaaggaagcgttgtcacctgaggcgcgatacggacacgttgaaaactatttgtatatgctgacaggcaggcagccgtccgcagcccaaaagaaagcgcttgagacgtatatgattctggcgatggagcacgggatgaatgcatcgactttttcagcgagagtcaccgtatcgactgaatcggacttagtgtctgccgtcactgccgcactgggtacgatgaaagggccgctgcacggaggcgcgccttcaggcgtcacgaaaatgcttaaagacatcggagaaaaagaaaatgcagaagcgtatttgacagcgaagcttatgaggggagaacgcctgatgggcttcgggcacagggtgtacaaaacaaaagacccgcgggcggaggcgctgcgcataaaggctgaagaagtggcgggaaatgatccgtcgcttgacttggcgctttatgtggagaaggaagccatccgcttgttagagcaatataagcccggacggaagctgtatacgaatgtggagttttacgcagcggctgtgatgcaggccattgatgtcgacaatgatttatttacgccgaccttttcagcaagcagaatggcaggctggtgcgcacatgtgcttgaacagtccgctgacaacatgatttacaggccgtctgcgaaatacaccggcgcttttcccgaaacggctcagcagctttaattaccggcatatttgtccgtttaactccccgcactgcgtggtatcgtctcagtaataccaattgcaggagtgtgagaatatgaatccgatggacagacagacggaaggacaaaagccgcaggtgcaaaatcgccagcccggcattgagtcagacatggagccaaaaccgctcttggaggacccggatgtaaaaggatcgggcagattaaaaggaaaagtcgccgtcatcacgggcggagacagcggcatcggcgcagcggctgcgatcgcttacgcgaaggaaggggcggatcttgccatcctgtacctagacgaacatgccgatgccgagagaacgaaaaagcgtgcggaagaataccaggccgattgcctgttaattccgggagacgtcggtgatgaggcgcattgtcagaaggcggtccggcaagtcttagatcactacggaaaaatagatattctcgttaataatgcggctgagcagcatccgcaaaacgggattcttgatattacagctgaacagctggagaagacattccgtacaaacatgttttctatgtttcatatgacaaaagccgtgctgcctcatctcaaaagagggagcgccatcattaatacaacgtcgattaccgcttatcagggagacacatcattgatcgactattcgtgcacgaaaggcggcatcgtttcctttactcgttcaatggcgatgtcattggccgatcaggggatcagagtaaatgcggtggcccctggcccgatctggaccgccctgattccggcaacgtttactgaagaaaaggtggaaaagcatggtctggacactccgatgggaagaccgggacagcctgcggaacacgccggagcttacgtgcttctggcttcagacgaatcttcctatatgacggggcagaccattcacgtaaatggcggcagatttatttcaacataatacgcaagtcttatcccgcgcttttaaaaagggcgggatttttatttgaacgtacatatgaatacgattttaaaaaaataaaagtcgccagctgaatcactaatgttaatatttcacagtggaaaatccgctgagttctgtttcatgaaaactaaaaataatatatagaattttcaaaaaagttattttcatttttatatttttcgctataatatgatgtaggagaaaggaatgatgtgctgaaacatttcatgcgaaaaataagaatttagtcattattgcaattgttatctgaatattctaacatatattggtttacaaggagtgaagcagatgaaggggagcgtattcagaaagaaaagcattcaggacctgcttgccgcaacaggcggggaaaagtcgctgaaaagagagttaggggcctttgatttgacccttctggggataggggccatcatcggaacggggatttttgtattaaccggaacaggcgctgtcacggcggggccggggctgaccgtttcatttgtcatcgccgctcttgcgtgtttatttgcggctctgtcctatgccgaatttgcttcaagcgtcccggtttcaggttccgtctacacgtttacttatgcgacactgggtgaacttctcgcgtttatcatcggatgggatttaatcttggaatatatgctcgccgtcagcgcggtttcggtcgggtggtccggctattttcaatcattcttggcgggcttcggcattcatcttccgaccgcattaacggccgcgccgggatccattaaaggcacggtcacattctttaatctccccgcatttgttatcgtgcttgcgattacattcctcctctacttaggcattagggaatcgaagcgggtcaataatattatggtcattttgaaggttctggttgttctattgtttatcgccgttgcggccgtatatgtcaaacctcacaactggcagccgtttataccgatggggttcggcggtgttttcagtgccgcggcgctcgttttcttctcttttatcggttttgacgccgtctcttccgccgctgaagaaacgaaaaatccggcaaaggatctgccgaaaggaattatcttttcattaatcgtctgcactgtgctgtatgtgaccgtatcggcgattatgacgggcgtcgttccgtttgcccgctttgaaggcgttgaccatcccgtgtctctcgtcctgcagatggcaggacagaattgggtggccgggattattgatatcggcgcagtgttggggatgacaacggtgatgctcgtcatgctgtacggccagacgagggtgatgtttgccatgtcccgtgacggtttggtaccgggggcgctttcaaaagtccatccgaagcataaaacgccgcacgtggtgacatgggtgttcggcatcctgtcagcattactcggttcgctcgtcccgcttgatgaactggcgaagctggtgaacatcggcacgcttgccgcgtttgtcctgatttccgtggcggttatcgtattgagaaagaaacagcctgatctgccgagggcttttaaatgtccgggggttccctttattccgatattgtccattctgttctgcgtgtttttgattattaacctcggcgccaccaccatattccgtttctttatctggctgatcatcggtctggtgatttatttcttatattcgagaaagcattcgaaattaaacggggatttgtaaggagcggcacccgccgctcctttttatttttcggaataatgaaacatattgaaatgggcttaagttatcgcagcgaataagggataatatagggcggaagggaagtggaaagtcgtgtctgaccaaaaaagggttcaatgggcctcgaaaataggatttattatggccgctgccggttcggcgatcggtctgggagccatttggaagttcccttacgtagcgggtacgaacggaggaggcgctttttttcttttattcgtcctctttaccgtgcttttaggctatccgcttttgctcggtgaatttattttcggaagacggagccagacaaatgcgattgatgcctacaaacaagccgcgccgaagtcggtatggcacctcacgggttatgtgggtgtggcggcctgttttttagttttgtctttttacagtgttgtcggcgggtggattttgctttatgtgttaaaagctgttacgggttctttatccgggctcactcaggagcagtacggaacggtgttcgggacggtcattgaaaatccgatccagactctcgccgcgcagcttgtatttatgatcttgaccgtggcggtcgtcgcaaaaggcgtgcagaaagggattgaacgtgtcagtgcggtgctgatgccggttttattcgtgctgtttctattgcttgtgctgcgatcagtcacgctcgatcatgccgttgaggggattagatttttattggttccgcactttgaagatttgacgccggaatccatcctatatgctttaggacaggcgttttttacattaacgctcggtgtttcggtcatggtgacatacagttcgtatctgccgaaaacccaaaatcttccgggttcggcgggttccattgttttgatgaatgtgctcgtcacgctgtttgcgggactggccattttcccggcggttttttcgttcggctttaaaccggatgaagggcctacactgctgtttaccgtgctgccggctgtgtttgaccggctgccgttcggctcgctgttttttatcagctttttggctgtctttttcttcgccgctctgacttcggccttttcgatggtggaaattatcgtggcgactgtcgggaaaggtgatgaaacgaaaagaaagaagctgtcgtggacaagcggtttgctcattttcttagtcggaattccgtcctgtttatcatacggtgttctcggtgatgttcatttgttcggaaaaacgttttttgatcttgcggatttcaccgtcagcaatgtgctgattccgctcggcgctttattaatatcaatcttcgtcccgctgaaaataccgaagcaggagctgtttgccgagatgaaaagcggttccgccatcggctatcgtttctttcaggtgtggtatttccttttgaaatatctcgtgccgctggctatcatcgtcgtattgctgcatttaatcggcgttctttcgttttaaaaaaacaggcccccgtaaaagggcctgtttttatgtttaaaaaccgaattgcagattcgtatcaaccgcaacgatcgtatatacacagacaatgacgaacagattgagaatgacaccgagcagtcccgggcccgtccgtccttttttaataaacagctcaatgatgccgaacggcacggcggccatcgcaaacggcagcatctgataagaatagaaagtcacattgctgatgattgccacgttcaaaagcagcagcgacaaaatcgcggtaccgactgatatccagccgaaaacattatgctctttaaaaattcttaccaattccataattccacctcaccgatgtttgctgcttttactgttttgtttttcagcagacgttcgatttcttttgtcggccccgtcacgacagagccgtatacgttcattccgtgatgttcaacatagtcgattcggctgcccagattcatgtctttgcgtttcgatattgcatgcgcccattttttatggcgggacataaattcaagggcattgataaattgttcacggtctgtctgtccttgcgtttcgaaagaggacaccatcttagaatctttcccgggaaatcctaacggctcggcataaggactgtctttcagatttttctccgtttcgaccgcattccataaaaacttcacatcgtattttttaaaagttgaatatacttgagaagaagggtaggcccggtcataagaaagatagacctccgccacgcttccttcaggcaatttttttaatgtctgaccggctttttcaatcgtgcgttcctttaagccggaaggatgggcgaaataatgctttgcctgtgccgcgtctagatcatagtagttaacggcaggcgatttgaccgtatctaaaaacatttcaatccgttctccgccgacggatttcgtttttgtgccgatctgcttttgcagcggaaattccgtattcattccaaacagcttcacctggcttttcagtccggaggtatcgacgaggacgttcggcattgtggtcgccaccgtcactgccgcggtctccattaattgattgccggtgctttcctttcctcccagaccgtaatagaggtagcttcccaaagtgcaaagcggcaaaatcatcaaagtggagatgacggcgagaactgaaatccgcaaatacgatttgcgttttccgtatgataaaatggccttctgtttttccgggctgatgccgacgtcccattcccgatcgtcctgcatttcgctttcaatcaattcctgatagacttccagcttttccagctcttcttcaaaggcggccatttcccggtcgctcatttctccatttttgtattggtaaaaacgctttttaaattcttcattcatcattaacacctctattataaagtgctttcagccgctgtctggcacgaaataaaacacttttaaaattagcctctgaaatattcataatatgggatgcttctttgtaattcagttcttttaaataatacagtgttaaggcctcccgataattgtcgggaagttcggacatataccctgtcagcacttccttgatttcaatctgatgagccgggctttgaacagccgtctgaaaaaggctcccaattaagtcatcggaaatggtcacttcctttttatgttttctgacataatctataaacgcatttctcgccacttgaaaaagccatggctttactttgctgtggtcgtaggagtgaatgtgtatgtatgccctcataaaggtttcctgcagcaaatcttcagcgagatgcttgtcttttgtcatggagagcaggaaccggtaaacatcattcatatacatttggtaaatttcatcgatcgtcactgccttttctcccctctatgttatacacgcataagaaaggtttaaagttgcacgttccatgcaaacggcttaaattcattttcacctcatcaaacaccatttctctatagtacccaaaatccgtcataaaagatagagatcggcggaggaaaaatataattattagtaccaggtaataaaaaatattgttataatagagagagagaacacttttgatcattacaacaaaggaagtgcgttatgtataagttttgtgcaaatgccatcaaatgcattctatccctgcgcggaggagtgaaagtgtacaataaagagaatcttccgtctgataaaggattcgttatcgcgtgcacgcatgcgggctgggtggacgtcctcacgctcggtgtcgggatattgccccatcagattcattatatggcgaaaaaagagctgtttcagaaaaagtggatcggacgttttttgaagaagattcacgcgttcccggttgaccgtgaaaatccgggcccgagcagcattaaaacgccgattaagcttctgaaggaaggaaagattgtcgggatttttccgagcggcacgagaacttctgaagacgtcccgctgaaaagaggggccgtgaccatcgcccaaatggggaaagcgccgctcgttccggccgcatataaagggccgtctacgggaaaagcgctgtttaaaaagggaaaaatgcggcttatcatcggcgagccgatttttttggaggacttttccgatcttgcgccgaaggagaggcttgcggccatgacagaagagctgaatgccagaattaaagagcttgagaaaaaacttgaacaactgtaaatgaaaaaaagcttgccgtctgtatcagacgcgcaagcttttttgttatgcttctttttgttcggcggtttccagcagttcatcaaacgccagttttttcacttcgatatatgcgacgtggtggccgtcaatttcattaatgataaattcgcagccttcttcgataatcgagtcgtattgttcgacgtcgtatttctgggtaaggaaccagccgccgatggtgtcgacctcgtcattttctaaatggatgccgaggagttcgttcacttgatcaatcaggaccttgccgtcaagcatgtaatggccgtcgccgagtttgcggatttcattgatttcatcgatatcaaattcatcacggatttccccgacgatttcttcaataatgtcttcaacggtgacaagccccgcggttccgccgtattcatccgacagaatcgccatatgaacccgttccttctgcatttttacaagcagatcgtgaatcggtgccgactcaatcacatggatgatcggattgacaaaatccgtaatcggcgagtcgactgatacttcgccgctgatgcaggcggtcagcacttctttaatgttaataacgccgataatattatctttgtcaccctcttcgacagggtaccgggtatatttttcaatctgaatgatgtccatcatttcagagattttgatatcatgcggcagactgacgatttccgtacgcggaatcatgatttcttttgcaagtctgtcgtcaaattcaaagattttgttcacatatttaaattcagactggttgatttcaccgcttttatagctttccgataaaataatgcgcagctcttcttcagagtgggcaagctcattttcagacaccgtctccagaccgaacgccttcgttaaaagacgggcggagttgttcagaagccagataaacgggaacatgatgcggtaaaaccaaatgagcggtttcgaaaacagcattgaaacggcttccgctttctggatggcgactgttttcggcgccaattctcccacgaccacgtgtaagaatgtaatgatcgcataggcgagaataaatgaaataatatgcgataatgagcttggtacgtttatctttgtgaaaagcggatgaagcaagcgttcaatcgttgattcgcctaagacaccaagaccgatggaagtcaatgttatgccgagctggcacgccgataaatactcatctaaatgcgtggtcacttttttgacaccgattgcggctttatttccttctgctataagctggtcaacccgtgagcctctgattctgattatcgcaaactcagatgctacgaaaaatgccgtcagcgcgattaaaaccgcgactaaaatcaaattcacaatgtccaattagaaccttcactccttttgggaagatgaaggtaacacctcctgttagtaagataatggtttaacttaacagcagcataaatgattgaagcactgcaagcttttctggagccagcctttttttcagctgggcgcgctcctctggttcaagcttttcaaaccgattcaagatcacggagatgttttgattcatgtgatcaatttccgatgccagatttccaatatcgtcaggcagggctgaagagggaaactggttctccagtcgatcttttatatcagacagggccaatcgctgctttttacaagcgactataaactttaaccgattaagtgcaagtgtatcgtagtaacgatagttcgaacaagacctgtcaggctttaaaagcccgaggtttgtgtagtaatccaccgtgcgtttcgttacaccggcaagctctgctaattcactgatgcgataagtctcagccccatctaaatccctccccaaccatcacgttatagttatgagaatagtttaatatatgaaggggagtttgcacaagtttattgttttccgtctttctcctgaaacggcgcggcgggctgtctgaaaaagcgttgactgcgccaggtaaatctttcataatcattgtaaatagaaacggaagaaaaagacagaagggacagatgacagtggccggtttatcacgggaagtgacacagaatctggagaaaggttcatggatacgcaaactgtttgatgaaggcgcgcggctgaaaaaagagttcggcgccgataaggtgtttgacttttcaataggaaatccggttgcggagccgcctgaaacgtttaaaaaggcgctttgcgaagcggctgaaacagggcggcacggatacatacaaaaccaggggcttccggaggcgagagaaaaggttgcacgctttttgtcagagcggtttcagacagaaatttccgccaggcatacagtcatgacggtcggagccggaggggcgctgaatgtcgcgctgaagagcattttaaacccggaggaagaagtcatccttctttcgccttattttgcggaatataaagcgtatgttgaaaattaccgcggcagacccgtcatctgcccgctgactgactcatttgagattgatattgaagcggttaaaggtgcgatcaccccccgtacgaaaggactgatcgttaatacgccgcataatccgacggggactgtgctcagccagaaaaaccttaacgaattaggcgccttattaaaagaagccgaagagcggaacggccaaagcatatttattttatttgatgaaccgtacagccagctgatctacggagaagagcaggcgaatccgtttcaggcgtatcaccgcgtgattttagtcagttcgttcagtaaagatctcggcattgcgggggaaaggctcgggtatatcgcggcggacgcccaaatgcctgagggcgatcttctgacggatgcattcgttttctgcaaccggacgctcggctttgtgaacgctccggtcatgatgcagcgcgccgtggcgaaaatggatgatctttcgattgacgctgaaccttacagaaagcggagagaccttatggtggacatcctcacagaagccggcttcgaatttgaaatgccgaaaggaggctttttcgtctttccgaaatcaccgattgaagacgaggtggcgttctgcatgcatgccgcacagaaatacaaactattgatcgtacccggcagcggatttggaaaaagcggctatttccgattatctttcagcgtgccttcggaacagatcagatattcgcgcgatattttcaaagcactgtatcaagatttttcttcatagcttccaatatataaagatgggagaacggacacatgtcgaggagaaataatggcacatcagacatcagcattacaggaatcggagtcttaaccgcggtcggacaaggcaaggaggcgtttctcgctgcgctcatggaggggcggcacgcctttgatgtgatgaaacgccccggccggcagaaaggcagttcgtttatcggcgcggagcttagcgaattaacgccgccggacgcgctgtccaagcgcttgtaccgaagggccgcattatcaggaaagacggcgcttatcgctttatatgaagcgtggcatgacgctcaattagacggcgctgaccacagccgcaccggtctgatcatcggcggctcgaatatgacgcagcgcgaattgctgcaggcctttgagaaaaacggtgaaacgccgcaatttgtaaatccgacatacgggctttcttttatggatagtgatttgtcggggctttgtacggagcaattcgggataaaagggccggcctttacggtcggcggcgcgtcggcaagcggccaggcggcggttattcaggctgctcaaggaatcaaaggaggcctgtttgaccgatgcatcgtgatcggggcgctggccgatctgtcgtacatggagtgtcatgctctccgttctttgggagcgatgggcactgatacatacgctgaacggcctgaagccgcctgccgcccgtttgaccggcatacggacgggtttatattcggagaggcgtgcggggcgattgtgctggaacgcgctgaatctgccgaagagaggggcgcgcgttcgtgggccggcttaaagggctgggggatggcttccgatgcaaaccgcaacccgaatccttcagcagagggcgaaatgacggtgatccgccaggcgctggagcgggccggtctttcagcaaaagagatcgattacatcaacccgcacggcaccggttcgccgatcggtgataagactgaatgccgggcgctttctgaaagcggcctgtcgcacgcgcggattaatgcgacaaaatcgattaccggacacggtctgagtgcggccggaacggtggaaatcattgctgctctcttgcaaatgcgggaaaacaagcttcatccgatccgaaacttaacggagccgattgacgattcatttcagtgggtgaccgacgggccgagcgcccataccgtacaccatgcgttaagcttaagcatgggattcggagggattaatacggcgctttgtttagaaaatcatttccgaagcagataacggcagccttctttttgaaggctgtttttatatgatgaaaaatctgaaaatgatgaaagaatggagttgtgatacaataaactatacaaatgacaatcatgctttgacttaggaggtggcaggatggggccctctgtgtagtcaatcacccatttcgttcctctcgcttaagaaaaaacgatgaaatcaggaggtgacgtccttatccttcaattcgggataaggtgaaatggacgatattgacagtttgattttaatcggtgtgctcattgcgttaacggcgtttttcgtggcgagtgaatttgcgatcgtcagagtgaggagatccagaatcgatcagctcatctcagaagggaacagacgggcggtgctcgcaaagcgtatcattacggatcttgatgagtatttatccgcctcgcagcttggcattacactcacatccatcgggctcggcgtactgggagagcctgcatttgagcggatgcttcatcctgtgtttcagggcatggggctgccggattcagccgagcatgtgactgcttttgctgcggcgtacgggctgattacgtttttacatgtcgtcgtcggtgagcttgcgcctaaaacggttgcgattcaaaaagcggaaaagctgacgttatggatcgccggaccgcttcggttattttacgtgttcatgttcccgtttatttgggtgctgaacggctccgcgagaattctgaccggtttggccggattaaagccggcatctgagcatgaaggctcccactctgaagaagagctgcggatcctgctgtcagaaagtttaaaaaacggagaaatcaatccgtctgaatatacatttgtgaataaaatttttgattttgataatcggatcgccaaggaaatcatgatcccgagaaaagaaatcgcggctgtttccactgatatggacgtgccggaaatgcttgatatgatgctgaaagacaaatatacgcgctggcccgtaacggacggggacaaagacagtgtcatcggcatgatcaatacgaagcatctcttttcagatctgctgtttatgacagaagatgaaaaagaggaagtatccatcacgtcttacgtccgcccggtgattgaagtcatcgagacgatcccgatacacgacctgctgataaaaatgcagagagaacggattcatttggcgatattgtctgatgaatacggcggaacgtccggtcttgtgacgaccgaagacatccttgaagaaatcgtcggcgatatcagagacgaatttgatgaagacgaacagccgcagattcaaaagctgtccgaacgccattatgtgctggacggaaaggttcggattgatcaggtgaatcatcttctcggcgcagggattgaagaggaagtcgacacgatcggcggtcttgtgctgaaacggaatattgacatctgtgcgggtgagtcgatacaaatcgggggatacactgccctcatattagaaatggacggccggtttattaaacagcttgaactcaaagaagaacagggccgcccgggcggtcagggaacaataaaccgccagctgcccgtgcctgaaacggtcatgcttcataacgcaaccttgagcgaaaaataagctcaaggtttttttaaatggatatcataacaaagccgcaccagaacgccaaaaggcttccggctgctgaaacagcgatgtagagcaggctttcctttatgcggttgttcatcatcagctgcacggcttcaatactaaacgtggaaaaggtcgtaaacgcaccgaaaaagcccgtcgcgatgatgatgccggcagaaggattatccaggcccaggccggtgaacatgccgaggccgaaggagccgagcaggttgaccgcagccattccaagcggaatcggaaaaccttttgttctttctgaaattgctttacccagcagagaccgtaataccgctccgatacccgctgcgataagcatcaggacaatcgtcatggcgtatcatgcccccttcccgcagagtgaagggcaatccgccgtccccagaaaatgcccgcgtatgcaagggcaatgccagagattaaagtcgcggcagcataacaaaaagccgctgcgggagacgattgcagcagaaaaatggtttcttttgcgaaggttgacatcgtcgtgaaacctccgcaaaaaccggttcctaaaaaggcggtcaaaagagggcgtttagcccgaatgatgaaataacccgtaataagaccgagtaaaaggcttcccgccgcgttttcgaggaaagtggccgccgggaaagaaccgctgtgaatgtgcgcgctcatttcaaagcggagcaaagcgccaagcgcgcctccgataaaaattgcgatgtattgtttcatatcagccatccttagaaataaaatccggaaaatcagttacaatgccgtcaactgccatcatttgcagcttttgggccgtcttttgatttctgaccgtccaggcaaatactttcaggccgtgtctgtgagcggtggaaatcaagaaccgattcaggcgggtatatttaatattgacataatgtacggctgatttgtaggcggccagctggcttttggaaaacatcccgaagctgggtcttgcaataattgcagtcggaacggacggatacatgccgtgaaaggtctgaatcgacttgaggctgaatgattgaacgatagggtggatggaaaaggaaaacctgcttaacagctggccgactgctttttcaagaccgacttgagaaacgtgccctttcagttcaattaaaaatccgattttagaatgataacgcttcaagacctcttcgagcaggggaatccgctctcctttaaactcagccccataccagctgccggcgtccagagactgcagcttcttcagcgtaaaatcttttacaaaaccggagccgtccgtcgtccggtcgactttgtcatcatggatgacgacaatctggccgtcttttgtgagctggacgtcaagctcaatgaaatcagcgttcatttcggcagcgatatcaaatgccgcaaatgtattttcgggcgcgtaaccggatgcgccgcgatgagcgatggtatacaagcttgtcagctcccctcatgggcatttctgttattatatcagattcgtatatgcacagcgattcaaactggtgaatgtgcaaaacagtatttttttggaataaagatagtgcttttttcggtttacaatccgcagtgatgatttataatggcaaaaaggaggcgagatcatgggaaaagggagattgaaagtggaagaaagaattaaggccgaaaccgatgccgaaatccaaaaagcgactctcctgaaacagacacaatcaaagaagaaatagtgcctgaccctgttgtatctggctgaaagatgaacgaatgtgtgaaaaccccggctgtgctctgatgccggggtttttcaggctgcctaaagacattaaaagaagctgatgtccgaatgttttagtataatagattttcgacaagacaaaggagcatgccatgatgacacaatttcagagcttttttacgcttgaccatatttcgcagatcagtatcagcatcggaattttagcggcttttctcgttttgagaaaactgtttgtcaaatacttttttcagctcgtttacaaattggcgaacaagccgaaaaccgacatattcaaacagattgccgtagcgtttgacaagccggccagatggtttttcgtggcgctgggtctgtttttggcgattgagtattcgccgtttttagacgggcagatggacattgtcaaaaaattgtaccgctctctgatcgttgcgctgatcgcctgggggctttgcaatctgacatcggcgtcttcgtttttatttcataaagtcaatcagcgttttgagcttgatatggatgacattttggcgccgtttttatccaaggtgctgcgctttgtcattctggcgctcagcgtcagtgtgatcgcgcaggaattcaattatgatgtaaacgggttcgtggccggactcggacttggcggattggcctttgcgctcgcggctaaagatacgatcagcaattttttcggcggcattatcatcattacggaaaagccgtttacgatcggcgactgggtcgagacgtcatctgtaacggggggcgttgaagatatcacattccgaagcacaaggttccgcacggcgcagggggcgcttgttactgtgcccaattcaacgctgtccatggaagccatcacaaactggacgaggatgacgaagcgccaggtcacgttttctgttcgtgtttcttatgcgacgccgattgatcgtttagagcggtgcatcacaaggctcagagaaatgcttcgtgaacatgaaggcgtgcatgatgatacgattatggttaactttgacgtgtttgcggacagctattataatctgtttttcaacttttacacaaagaccatcgtctgggcggaaagcttggacgtgcggcaggatatcaaccgccggattattgatatttttgctgaggaaggcgtggagttcgcctatccgggccagaatgtattcgtaaaacagaagagccacgatgatccggttcatgtgaaggatcattccggagaaaaagaacgggcataacaggcgccgttcttttttcatgatatgataaaaagaaaaggtggtggaagagtggaagcatttatgacattgatcaatcaggcggaacgtatcgtggtgctgacgggagcgggaatgagcacggaatccggcattcctgattttcgttcggcgggcggtatatggaccgaagacacctccagaatggaagcgatgagcagggaatactttgaacgccgtccgcgtgaattctggcctaaattcaaacagctctttcagatgaaaatgagcggaagctatgagccgaatgccggccatacgtatttggcggatcttgaaaagcggggaaagcaggtagacattttcacgcagaatattgacgggctgcataagaaagcgggaagcagcagtgtctatgagcttcacggttcaattcagaccgccgcatgcccccgctgcggagcgcgctacgggctttctcatctgctgaaggatgaggtgccggaatgtacggcggaaatcggtgatcatacggtatgcggcaccgtattaaaaacggatgtcgtgctgttcggcgatctcgttcagcattttgaaaccctttatgaaaagcttgataaagctgatcttcttcttgtgatcggcacttcgcttgaagtggcgccggcaaggtttgtccctgaggatgcgggccggattcccggtttgaagcaggtgatcattaaccttgagccgacatattgcgactatttatttgatcttgtcatccatgagaagatcggtgaatttgcaaaacggatcagccccgcgacataaaaaagccggatcatatacagatccggcttttcttattcatggacgggaatcatttgatccgtcagaacatcaaaggagtagccctgggctttcagtttttggatcaggctaggcaaagcgtgcaccgtcgcaggcagatcgtgcattaaaatgacatgcggcctgctcgtatgaacgctttccaaatatgcgagctgattcaatacttccggcacgtaccgtgcgtttttgtacttccagtcttcactgtctatcgtccagtcccagtacacgaatccgcctttttcgagattcttaatctgggcatccgtcaatgacggtttactgccgtaaggcgtgcggacaagatccgtttttactccggtgattgcctcgagcgtatcgcgtccctgctgcatttcgttcagcggtgatgtcggtgtttgataaaacaggtgattatcgtgcgtcacgccgtgcaggccgagcgcgattccttcctgcttcgctctttgcacggaatgcttataggctttcatccgcggttcaagcataaaaaaagtggcctttgcgccatttgccttcaatacattcaacagctgttcagtatatggagacggcccgtcgtcgaaggttaaatataccgtttttttccctgggtcacgctctttctgcaaatgtttcattaagacgtcgggagaatcatttttcagccgcaggctttctgcttcatcccgaagctgcccgtttgcggtcacggtgacctgtttgttttttgcggcggaagcggaatatcccattatgacgattaccagaagcagtccgcacaaaactgctaaactcgtaagtttaaaagccaatgaaaacagagaaggggaagcaccttcttttgtgttgcgcataacaatctctccagtagcataagtttctgcataatgccgataacagcggaggcttgcgaagtgccataagttaacagcatatgtatgtcgaatcaagtatacaggaacaaaactggaaaagacatagaaaagatgtcgaataataagattttaagaaaaaaataaactccgcagccggctcgttcagtatgatagaatagttgacaataacagctgagaatgtacatcacggcagataacgattaggagggtttacatgaagacattagtaaacggccagttgattgatcgtgaagaagcggcagttgatattgaggaccgcggatatcaattcggtgacggtgtgtatgaggtcatcagagtgtataacggcgccttattcggtctgcgtgagcatatcgtccgtcttttcagaagcgccgcagaaatcggcatcaccctgccgttctccgcagaggacatagaatgggatctgcaaaagctcgtacaggaaaacaaactcattgacggcggggtctatatacagacgacgagagggaaggcgccgcggaagcaccagtatgacgaaggattggaaccgcagacgacggcatacaccttttcagtgaaaaaaccggaaaatgaacaaaaagccggagcgcaggccatcacggcggaagacaaacgctggctgaggtgtgacattaagagtctgaatttactgtataatgtgatggtaaaacaaaaagcctatgaagcaggcgcttatgaagcggtgctgataagggacggagcggtcacggaaggaacctcatccaatgtatacgccgtcataaacggcaccgtccggacgcatcctgcaaatgagctgattttaaacggcattacgcggatgaaactgttagagctgatgaaagaaaacgggattgaggtgcgggagaaggctcttaccgaagacgaactcagagatgcggatgaaattttcatctcgtcaacgacgtctgaattaatcccgatcgtaacccttgacggaaaaccggtcggaagcggatcgccgggacctgtagccaaaacgattcaggaggcatttcagtcgcacattcagcaggaggtcggcgttcagtcataagctgaaaaaaaggccggaacacatccggcctttttgcttcagtcagataaaaagagattcgatatgctgaacgagcacacgggagatcttctcttttgaaagacgatcaggttcaagcatggcatgcagcgccaacccgtcggcgatagcgtacattttctccgcttcggtttctttatcaagatttggtttcagaagcttattttcatccagccagtcaatcaggccgcggatatatgccaagatcccgtcctgctggggttgaaactcttctcccttatgtctggcataagctgtgaaagcgaaccatacctccatttcagccatcgtttcttcgtctgtcgggataatttcaagcatcagacgcaccgctttttctttcggcggcagatctttcatggcaacttcgttaattctggcggccgctttttcttttacgagtgtcatcgcataccctaaaagctcatcctgggtggtgaaatagtgcctcagcgcgcctaaagaaagacccgcttcttgggcgatgtttctcactgtcgctccttccattccccgctccaaaatcgtccgccaagtggcttcggctatttgttttcttcttttttcatgatcgattattttaggcatggttccagtgtaacaggaaatattttttcttgcaattttgtaatacagttgtactaaataaaaagcagtgatacaatgcattttagaaaacgataagggggaaccggattgaacgcgattgcttggattgtcatttgtgaggctgctttttgggcggctgtcatcttcggattggcggcgcgctatatattcaggcggcaaaagctcggaatgttttttttcgctctcattcctatattggatgccgtactgtttctggcggccgcagctgatttatacagaggggcggcggcgactatggcgcatgcggtggcggccatttatatcggagtgtctgtcgccttcgggaaaagcatgattcaatgggcggatgagcggttccgctattatgtggtcaaggaaggggcaaaaccggtcaagcggtacgggctggattatgccaaacattatgcaaaagggtgggggagacatgtattagcgtttgtcatcggcggcgttcttttagccggaacggtatttctcattcaggacgcttcccgcaccgaagcgctcagcgtactgttaaagggctggtctgtcgtattgtgcatcgattttttgatcatggcgagtttttttgtgatgccgaaaaaaagaagaaacagccgggagctgtaaaaaaagcagcttttgattaagctgctttacagaaagaattattttacgatcagcacgggaatatcggatttcgatgacagtttttcactgacgcttccgaataaaagttttttcagcctgttctggtcccggctccccatgacgatcaaatccgccgatatacggtcggcatgctcgataatggcatcagcgggatcaccttctaaaatgtcgatatccccgtcaatctggctgtcgttcatcagcattctcgcttccgcaacgatttcttccgtacggtcttcataaatcatcggatcaggggagattctttccgcctggagcgggtcaggaatgcttgcaatcccgccgccgatatacgttgccccggctcccggcctcgggggatcaacaatcgtccgggtatcttttgcattgtgggaatgtacgaccgttaaatccgcgtgaaacgtttttgaaaggtctatggctttttggagcgcttttttactatcatcacttccgtcaaaagctgctatcaaccggtctgcgtgaaacatcagcctcatcctttcagtaaaaaaggtttgttttacaatacccttgcggcagaaatgtaaaacctgcattgacaaaaaaaggatttgtttatatgatgaaggaacaatatagggaaaaaggaggtatggatcatgtcaaaactaaagcttgtcaactcatcttcagctgaataccggcgtgactcccatacagcttccgttttctgaacatttgcttaaaaacggggcagtcgcgcataaacggcgggtctgtaccttatttataataataagaggcatggagctgaggcttcatgtctttttttatacaaaaaaatgaaagaaagacaggtgtgatgcatgtggcggcattagcgaaaacaatgaaaaacaatccggaaaagcttgagggcggctgattgatgaaaggggatgacggtatttgtttactgtattaaaaaagctcgcgtggttttttaaagcctattggctgcgctatacgacagcgattgttctgttattgattgtgaatgtcattgagatgtttccgcctaaacttctcggtaacgcgatagacgatatgaaggcgggcgtgtttacgaaaagcgggatgctgttttacatatgtgtttttctcgcattaacggcagccgtctatttactgtcttatttttggatgtatcagcttttcggcggggcgaatgtcatggagaagattctccgatcaaaactgatggggaggcttcttcaaatgtcaccgccgttttacgagaaatacagaacgggcgatttaatggcgcgggggacaaatgacctgcaggccgtcagtatgacgacgggcttcggggtcttaacgctcgttgattcgacgatgtatatgctgacgatatttttgacaatggggcttctcatcagctggaagctgacatttgccgcgattattccgctgccgataatggcggctgcggtcagcctgtacggaaaaaagatccatgagcggtttacggaagcgcaggatgctttcggatcattaaatgacaaggtgctggagtcggtatctggcgtccgggtcatccgagctttcgtacaggaaaaaaatgatgtcagccggttcggtgatatgacggcggatgtatatgagaaaaatatgaaggtggcgtttatcgattcactttttgaaccgactgtgaagcttctcgtcggcctcagctatctcatcggtctcggctacggcgcttatctcgtttttcaaaaccggctgacgctgggagagctggtatcgtttaacgtgtacctcggaatgatgatctggccgatgtttgcgatcggagaattaatcaatatcatgcagcgcggaaatgcctccttggatcgtgtcaatgagacgctttcctatgagcctgacgtgatcgggcccaagcgccccgccggcatcaaggagcccgggcgtcttgtttttgaacaagtgactttcacgtatccgagcggagcgggaccggcggtttccgatgtatctttttccgtagaaaaagggcagacactcggcattgtcgggaagacgggaagcggaaagacgacgatcattaagcagctgttgcgtgaatatccgcccggggcgggagcaatcacgtttacaggcgttccgattcaggagatcccgcttgaggagctccgcgggtggatcggctatgtgccgcaggatcatattttattttctaagactgtaaaggagaatctgctttacggacggcaggatgcaaacgaagaggaaatcggcggcgcgctgaaagatgcgcattttgaaaacgatatcggcatgctttccgacgggcttgagacgcttgtcggcgagaagggcgtagcgctctcgggcggacaaaagcagcgcatttcaattgcgagagcgcttttgaccgatcctgacattctcatattagatgattcgctttctgccgtagacgcgaaaacggaagccgccatcattgacagcatccgtaaaaaacggcggcataaaacaacgattatcaccacccaccggctctcggcagttgaacacgcagatctcattctcgtcatggatgaaggccgggtgtctgaaagaggcacgcaccgggagctattggagcagaacggctggtatcgaaaacaatatgagaggcagcagctgtcatctcttgaagaaggggggacgggcgcatgaagaccgggagaagattatggaattacgcgcttcaatataagaagctgctgatatgggcggtcgtcctgctcattattgcggtcggcactgagctgaccggcccgtttatcggaaaaaaaatgattgatgaccacattctcggcattgaaaaaacatgggttaaagcctctgcggacgatccgggcgccgtcaggttccgggggcatgattatgtcagggaggaccggctcaaaccgggggcggataaaaccggagaggcgcacatttatcaagtcggtgcgggctactattttgttgaccgtcccgtcagttttgacggaaaccgttcggtggctgacggccggctgacaatatcaaacggtaaagaaagcaggtcatatcccgccattacgttatcaagacaggagatttttgaattttaccgtccggaaataaaaggattgctgacgttgaccgccatttacgccggactgctcatgttttccgtatgttttcattacggtcagcattatctgctgcagatgggagcgaaccggatcatacagcgcatgaggcaggatgtattttcacacattcagaaaatgccgatccgctactttgataatctgcctgccggaaaagtcgtggcccgtattacgaatgacacagaagcggtcagggatttatatgtaacggtgctgtcgacatttatcacaagcggcgtttatatgctcggcatttttacggcgctgtttatgcttgacgtcaggctggccgccgtttgccttctgattattccgattttaatgatctggtcggttgtgtaccgcaaatacgcatccgtcttcaaccaaaaaatccgttccattaacagtgacatcaatgcgaaaatgaatgagtccattcaaggaatgccgattattcaggcgttccgccgcgagaaggaaacgatgaaggaatttgaagaattgaatgaagctcattttcgctacaaaaacaaaatgctgtccttaaattccctcatgtcccacagtcttgtcaatgtgttgcgcaatctggcgtttgtcgggctgatctggtatttcggaggcgcgagtctgagtgcggccggaattgtttcgatcggtgttttatatgcatttgttgattatttaaaccgtttgttccagccggttacgggaattgtcaaccaattttcgaagcttgaattggcccgtgtctctgccgccagagtatttgagcttttacaggaggaggaaacggaagaaacaggcgctcccgcagacagaaaggcggaagggactgtggaattccgcgatgtttctttcgggtatcgtaagggagaagaggtgctgaaacacatcagctttacagctgaaaaaggcgagacggtcgccctcgtcggccatacgggttccggcaaaagctccatcctgaatcttctgttccgtttttatgatgccgaaaaaggcgatatcctgctggacggaaaaagcatatacggcatgtcaagacaggagctgagatcccatatggggatcgtgcttcaagatccgtatcttttctctggaacgatcggctccaatgtgaccctcgatgatcagcgtatttctttggagcaggcggaagaagcgcttcgccaagtcggcgccgcaagtcttctgcaatctttgccgaagggcatcagagagcccgtcactgaaaaaggcggcacactatcctcaggccagcgtcagctgatttcttttgcaagagcgcttgtgttcgatccggccattttaattttggatgaggcgacggcgcacattgacaccgaaacagaagcagtcattcaaaaagcgctgcaagtcgttcaagaagggcgcacgacatttattatcgcccaccggctttccacgatcagacacgcagaccagattctcgtgctggaaaagggccgcatcattgaaaagggaagccatgacgaattaatggcgcaaaaggggcagtaccatcaaatgtatgaattacagaaaggaacggcgaaatccgcggtgtaatcggaaagggtgaatcaaaaagattcgccctttttttcattcagtaagccagtcctacccgttttctgacaaactgcgggctgatcagctcgcggtacagaaaatgcgcagtgtctccgactgtgatttcggcgccgtcttcaggaaggcgatcctgttcgaaccggtaaactccggcagcgtctccgtcaggaaggtaggtagggcagatgatcgtccagtcaagatcctctgccagcagcatctcgtatacgcgggcgtgttcctttgcggctcttgttgattttcgttttgattctgccgattcaaaacggtattgatcaggcataagccgtgattgaaggatacccgcggtgccgatcgtaatcagacgctgaacatgatgccgtttcatgccgtctattatatgagtcatagcggctgaaagggtatcgtcaccgtccgtgccgagacagctcacgactgtgtccgctttggaaatcaatcggcttacatcttcccgccgcctcgcattccctgttatgatctgtttttcaggaatgggaaggactgttccggctgatctgacaagagcgaatatctccatgtgtccatgtttctgcgcttcttttataaaagcctgtccgactcttcccgttgctccgagtaaagcgatgttcatgtaaaaaacctcctcgccgctcattatatcattcaaagcagcggggaaaagaatgcctgtgaataaacgggaaatggtgggcaacatattcattgaccaaagaaacacttacgaactgaaacagctcccaattgactgaggcaatgaatgacatgttttccctccttttttcctagggtatgtggaataggaaaaaagggtgacggcataaaagaagacgcggtatcccgcgccttctgtaagccatttattgagttattgtacgccttggccgcccatgttctgctgtgcgaaagatactaaacgtttcgtgatttctcctccgacagaaccgtttgcacgagaagttgtttctccgccaaggtttacgccgaactcagaagcaatttcgtatttcatttggtcgattgcttgagcagcgccgggtactaatagttggtttgaagagttgttgtttgccatttgtatgatctcctttattaagtagtatggttgggtttgctggaattgcaccagccgatgattttcggaatgaaaaccattgccagctcggcttcacccaatgctgtttgccgctttgtactacgtattatggtgaatcaaacggcatctcattcggaaaaccgggtggtaaatagcggaaggaaaaagaaaagcccagcctgatgcggctgagcttttagctttcagtcatatatgtgataaagcattaattcatgcagctcttttacgagagccggctcttcttttcccggatgtgtgtgtccccattcaatgtcaccggacttatggtaaatcccttcgtaatgcgtaccctgccagtaaaatgaaatccgccatccgggcagtttctcttttttgaataacggtttccagctgaagtgcgaaatcatgacgttcacgctccttgtaggaaatgttgatcttgttcattgtagctcatcattctgtgcctgtcccgggtaaaaccaaaaaaagacagcctcaccgccaaagtttttcaggggcggtgatggaccgttctgataaatatgacgcgtattcaaaatttctccgttttgtcaggtaatcgaccgatctcagcttcggatgggaaaaaatgctgcgcccggggcgggaattggcttcaaacatccaaactttccctgaattatcgacgccgaggtcaaaaccgatttcgccgataaaaccttcaatgtgctcatttaacacgcggctgaccgccaaggcggcttttgaaagtttccgcatcatgccgactctctctcgcggatcgccgtataattcagctaacgtcctgacttctccgccggttgccagatgcgtcgtgatgctgttttcaccggaaatttttgccgcaatggccgtcactgtccatttcccctcggcgtttttattcgtgtgcaccctgaaatcgacggggcgtccatccagccggatcaggtcaatgccttgctgaattaaaaatgcggacgggtcattgttttctttaaatgatttcatgaaggatgccgcatctgaatactctgccgtcacgaccgttttttcctcattcgtgtgtttgacagataagccggcatctgttttttccaccttgtaaatccccgttccgagtgcgccgtctgcaggtttgatatagacggtgtcaaatgtgctgcataacgtctctaacgcttccgcattcgggtgcaggacagattttggcagaagtgaagcggtgaggctgtttttttccagaagcttatgaatgtcccatttattaaagaattgaggattaaaccacggaatctgatagacattcatcagcctctgttttgtctgctgtaaaagcggaacttcttccgtttttcggctcgggagtctgtcatatacgacattcggaagcgggacggccgtccgtttccagctgttttctttataaatcagcgcttggacggtgccttcttcccagttgatctgatgagcaccgaaaacgaaacaatatccgttcgcctgttcatgaagagagagcatcttggaaaagaaggctgtacggtctcttaacgggcgggtcggcgatgatgtgaacccggctgtgaaaacgccgatcagcggaccgatgtgcaccgtctggccgtgtatgagaaagtcagcccggcttttatgcggtatcaacagctcctcaaacaaatcttcagaaaggagcgcgcttttttcaagtgattgagaaaaggctacacggcatttgacaaccttggtcccgaaggcagcggataaaagcccttcccgtttcatggaggaggggagaaacagcgtatttttgctttttttatcgatgccgacaatcatccctttatgattcacgcggtaatactcctttccggctttcctgtgactgaagttcgcggaagcgtctcagcggactcgtatacaaatcctctttcgcctccggagccacgcttaaaatagctttccgccccggctttgaattgacatccaaaagccagatgcgtccgtctttggcataacaaatatcgagccccagctcaaacagcggcccgaaccgttcgtcaaggaaataagggacggattgggtgatcgaaaagacatcatccaataaaacggcctgctgctttctcggaatttcctcaaaccatgtgtcaaacttaatcggttctgatcctccggggaaatgagataaaagaccgttctgataaccccttctgaccgcttttccgaccgtttcccaaacgcctgactcagttttgcgcatgaaaatgcggatgtcgcacggatgccgctctttatccttgatatttaagtaggattgaagcaaatagcggtgctgcagcacttttttgcaccaggacttaaaagacacgtgattggaaaatgattttgtttgtttgttttttccgatatagtaagtggccgtaattgattttttgcctgtttcaagcaggatgatgcctctgcctcccgcgccgaaagcgggcttaagtatacatgctttttccttggctaagtatgattgcacctgttcatagcggctgacttcggccgtttcaggaatatagggactgatcagatgatgtttttggagcgcatccgtgaccgtccatttatcaggaagcccccggccgataaattccgttttccgatattttttcagccattcgacgatcggtttggctttttgcgcttcagcggattttccgtaaaaacagcggtcgtaaatatattcgggaatatcgatttccgtttcgttccactttccgctttgcgggtgatagacgagcgcttttacgcgcaaagaatccggaaatatatcaaacggtgtaaagcgggctaagcgcacattatattgaggcgctctttcagccaattccccggcgtaatcttcttcgtgccggcgggatacagacataaaaccgagtgttgtcatattattactccccctttattcaaaaagccgctgatggaacggcccttccattcaataaatatgctaagcgcatcataaaagatgatctactgtaaagagtacgaaacagcatcttgccttattcctcacaaacaacaattcaggttcttcatttgcccgcatgcacgccagcctctataatacgaatagatatatcatcaagaaaatagaacattagatggaggcagaagaagaggaatgggcatagcaggaacgtttctatttatgattgtgatcggagccgcgatcggcgcggtgacgaatcatcttgccattcagatgttatttcgtccgtaccggccgtattacctgttcggaaaacgggttccgtttacgccggggctgatcccgaaaaggcgggatgaattggcaaaacaaatggggctcatggtgacgaaccaccttttaaccccggaaggaataaaaaaacggcttttatcagataccgttaaaaaccaggcgcttcttttcgccgaacaattcacacaaaaaatggccgcttccgagatgacggtgcacgaagctttggccgccgcgggcatccggaatccgcaggaaaaaacggatgcctggattgaccgttttaccgatgaaaagctttcggaactgtaccggaaatatgagcaccgcgccataaaagactggcttcctgatgagcttcaggaaaagctggatgaaaaagtcccgatggccgcagattatatcctgaagcggagcattgattattttgagagcgaagaagggaaagacaggctcggaaatatgattgacgactttttgaactcccgggggatgctcggcagcatggtgcagatgttcctcggcaattcaagcttggcagaccgtgtgctgcctgagctgttaaagtttttgcgcaatgaggaaacgaaaaagcttctggctgatctgctttctcaagaatggggcaagctcaaatcttatacactttatgaggccgatgaaaagtggaatgcgaaagatctgctgttcagcatgaaaaagcgggctttggccgcacttcaaaccgcgccctttttcgaatgccggctcggtgacatcatctcccgttatgaaggggagattacgggaacgtacgcgccgaagctgcttgatgcggcgctcggcagtattgccgctcatttggaggatgtactgaaacggctgcgtcttgaggaagtggtcaaagagcaggttgatcagtttcccgttgaacggctggaggaaatggtgctgtcgatttccaagagagaatttaagatgataacgtatttaggcggtctgctcggcgggataatcggagcaattcaggctttgtttgtcattcttttctaaggaaaacatacgccgatgatgaaagtcgctccgcagtctgttatagtggagtggtatgtccgaaaggaagaaaggagcggttactatggcagttcatttttatgatgcagcatatgatcttgaaaaagctttgcgaaacagtgatgaatacagccgtctgagagggctttatgatcaagtaaacgcagatgaatcggcaaaacgcatgtttgataacttccgcaatgtacagctgcagctgcagcagaaacagatgtcaggtgaagaaatcactcaggaagaggtagagcaggcacaaaaaacggttgctctcgtacagcagcatgaattgatttctcagctgatggaagcggaacagcgcatgagcatgctgatcggcgagttaaacaaaatcattatgaaacctcttgaagagctttacggcagcccggaataagctccaaacccctccatctatgaaatggaggggtttttttattcaacagaaaaatcaagcgaaccttttaccgtaccgttaatgatgacagacagagtgtgaattccccgataatgcttgcgggtggttaaatctttaagggaatgatgtttgctgaaggtttttacgtccccgttatccatggcggactccgacatcttaaacaccttgcggctgcggtgcccccttttctttacaaaatcaatcgcgtattcaaccctgactttttgccgggcggatgagcggatctgaaaagaaaaatgtatgcttgttccgatggcggccgtttccgaattcagtgtaaaacgttccaatgaaatccgggaggcgtcttcaaacccgaaaaccgcaagcgcctgtttgtctcctctttttaacagtgtcctgcaggcgtgtttcaaaatccagtccgtgtgcggacagcttccgaaccgctcggctgcgatctgtgccagaagatccggatgtgttttggagatgtcattcaggttattcgccacgctttttctgacatataacgagtcatcctgcatcaagcggtccagaacagggagaatcggagaaggatcttcaagaagagccggaatggagcttccccacggcagtcgcggtcttgagccttcgctggcaagccttctgacatgttcgtccggatgctccgtccaggaaaggaactctttgaacatcctctcccggtcaagcctgatatacgggcggaccgcaaattcggaagtggaaaaacgagtgaaaaactgaagcgccttcattgatgcttcccagtgatccgttccgtactgttggacataatcgggaaaaataatcccagcgagccctgtgaaatggggagctgtctcgtataagacgtcaagggcccgtatgtaatccttcggcagtgtttcatataaagagtctgtgatccggcgcatccgctgttttaacgtcagtccgggccaatcttcctgaaacatcagcgcccggcacttgtcccgctcaaaagccgggtacgccgatttgattctgttcagaagtgcttctgcaaattcttcgttataaatatcttttaatagagacatgacagtcaccgctttttttcttttattatatgcgaatatatgttccctttcaactttatcatacattcagcacagatatttcccctgatttttttagttaaaaaaacccttgttttttaacaatataattgagataataactctgaaagcgcctacacttacagatgatctaaggatacggtcgcctatactgcctggtatgttaaggggtagcaacagagagtaagtgaaacgagcgcatcaacggtcaaataaggtgttcctgatatatttcgtaaatagaaatacacattggggagaaggcagcaaatcgatcgtatcccaacaaaacgacagttcaaagtctgcttgaggcaggcttttttgctgcggagaaaaggttgttctaaacaaagagacagggtcatatcctaatgacaagtacagtcatcaaggagggggacttctctgtgtcaaaacaaatgctggcgttaaatatagacggagcgcttcttcgctccaacggcaaacttcatcagacgacaaaggatgccatcgaatacgtcaagaaaaaaggaatttacgtcacactggtcacaaaccgccattttcgctccgctcaaaaagtggcgaaaatattaaagctgaatgcaaaattgattacccacagcggcgcatacatttctgaaaaaatagatgagccgttttttgaaaagaaaatatcagaagatcacacgtttaatatcgttcaggtgctggaaagctatccatgcaatatccggcttcttcacgaaaaatattcgatcggaaacaagaagaaagtgaactccaatctggtcgggaaaacaatgattcatccgtctgacccgattttttatccggtgcagtttgtcgaatcattaagtgacctgctccttgatgagccggtttcagcgcccgtcatcgaagtgcatgccgaagatggcctgcaggctgatataacggatacgataatgaaagcattcccggccgtcgatgtgatccgcgtcaacggagaaaaactgaacatcgtgcctaaaggggtttcaaaagaaagcggactttcgatggtcgccgctgaactcgggctttcaatggaagaggttgtggctatcggccatcaggaagatgatctgccgatgatcgagctggccggtctcggcgtcgcgatggggaatgcctcaaatgaattaaaaagaaaagcggactgggtgacaaggtcaaatgatgaacagggagtcgcctatatgattaaggaatatttccgcatgcagcaccgcaaaggctttctcgataagttccatatgaaacggccgtaatcaagagccgcagacgcgaaacgccggtctgcggctttttcgcggattgattttagcctgttctttctgtacactaaagaaagttttgaatctgaaaaataaggtgatcacattgcaaataaaaatagacggcatcacggatgacaggctgcatcgtccgctgcaaaacatcgcgaatttattttttgaagagtgtgttcttgcgtacggcgaaacggaggaaccctctgatctcgtcatctcacttgccatttctcaagatgcagacagcgtgtcggtatccggagaaatcaaaggaaccggcgaaaaggaacatcatacgaaaccgcttcttgccggatggagcgaaaaagaagtatttaaacaggtgaaaaacacgctgtcatacgtctacttaaatcttcttcaatcgcatacgggcatgacacaaaaatggggaatcttaaccggcatcaggcctactaaacttcttcataaaaagctgcagagcggcctgacaaaagaagaggcgcacgccgatctgaaaaaagattatctgatccatgatgaaaaaatcaatctgatgcaggagattgtcgaccgccagcttgcggcggttcccgatctgtaccgggtcaaagatgaagtcagcatatatatcggcatcccgttctgcccgacgaaatgcgcctactgcacatttccggcttatgccattcaaggacaggcgggaagagtcggctcctttttatgggggcttcactatgaaatgcagaaaatcggagaatggctgaaacagcatgatatcaaagtgacgaccatttatttcggcggcggcacgccgacaagcattaccgctgaagaaatggatcttttatatgaagaaatggtccgctctttcccggatgtcgcaaatatcagggagattaccgttgaagcgggccgtcccgacacgattacggaggaaaagctggccgttttaaataagtataagattgacagaatcagcattaacccgcaatcttatgaaaacgaaacgcttaaggccatcggcagacaccatacagttgaagaaaccatcgaaaaataccatctttcccgcaaacacggcatgaataacatcaacatggacctgatcatcggcctgccgggagaagggacggctgagttcaggcacagtcttgaagaaacggaaaagctgatgcctgaatctttgaccgttcatacgctttcttttaaacgggcgtcagaaatgacgagaaacaagcataagtataaagttgccgacagacaggaagtgtcccgcatgatggatgacgccgtccgctggacaaaagagcacggctatacgccgtactacttgtaccggcagaaaaacattctcggaaaccttgaaaatgtcggctactccttccctggtcaggaaagcatctacaacattatgattatggaagaagtgcagacgattatcggcatcggctgcggcgcggcaagcaaattcattcatccggaaaccggaaaaatcacgcacttcgccaatccgaaagatccgaaatcatataatgaccgattcgagcattatacagaagagaaaatcaaatacttagatgagatgttcgtcaaatctgcattataatatcaaaaacggcacggaatcagcgtgccgtttttttatgtttaaccgtctgcaaaaatgggaaaagaccatcagactgttattcgtaagaggtgtaattatgtatgatgtcataggagcgggaatcgggccgtttaatttagggcttgccgcattgttagaggatataccaggaacagacgctctttttttcgataaaaagaaagaatttgcgtggcatcccggtctattaattaaagggacggatttacaggtggcgtttctggcggacctggtcacgctcgccgatccgaaaagccgctacacgtttttaaactttctccatgaacatgaccggctgtaccggttttatacgtttaatgaatttgatattccgagacgggaatttaacgactatttgagctgggcggcttcagaaatcaaatcatgccgtttcggctcagaggtaatcggtgtgaaaaatgccggcggacattatgacgtcagcgtcaagaacattgaggacggaagcatcagtgtctatcaaacgaagcatttcgtcatggggacggggtctgagccgcttattcccgcagagattgctgacgaagcgcgtcaggacacgatggtcagcacggaatatttgtttcggaaagacgagctcgccggcgccgaatcaattacggtggtcggttccggacagagcgccgcggagatcttttctgacttattgcacgatgaacaataccgccgcagccggctgcaatgggtgacacgctccgccggatttcgagaattggaaaccgccaagctcgggcaggaaatgtttacacctgattatgtggaatattttaaccgcctgccttttaaagaacggctgaacacgctccctgagctggacggactgcgccacggcattgattctgacacacttgccgccatttacgatgccctgtatcacagatcgatcagcggaggttcgcctgacgtgtatattcagccgatggcggagcttgaaaaaattgaaaagcaaaatgggcgctgcgtactgagctttcatcaatggcagatggatgaaacctttacggccgattcagaaaaagtgatattggcgaccggctttaaacctcatattccggaatggtttacggcaattgcccccgatatcgaatgggaggatgagaaacggtttaaagtgacggccgattcccgtcttatctttaaggacgacaggcggcatcattttttcacattaacgaatcttgatcatgctcacggaacaggcgctacgaatttgaagctgtctgtttacagaaaccaaaaaatcatcaataccattctggggaaagagcatttctccattaataaaaaaacggcttttcagcaatttcttcccgctcaaaaaaactgaccccttatgaagaggtcagtttttttatgatttctgcggcttcttttcaggcgtcttccatttgaacacgctgttcaacaggagatatatccgcttcgattctttcgtgagcaaagggccgaagatggccagtattaaaacatataaggcggcgaaaggtttaagtgaagcggacaggccgccggcgatgccgagatttgcgacgataatggagaattcgccgcgtgacacaatggtcagcccgatattagacgatgctttatgagaaagccccgcccggcgtccggcgatcatgccggcgataaagtttccggcaatcgtcagcagaacggcgccgagggcaagccataccgcatctccgagtgaaaacggatcaatgctgagaccgaagctgaagaaaaacatggccccgaaaaagtcacggaacggcacgacaagatgctcaatcctgtcagaatgggccgtctccgaaaatacgagtccgagcaagagcgcgccgatcgcttcagcgacatgaatcgtttcggaaaagccggcaatgaaaaagagcgcggcgaaaatgacgatgacaaatacctcgtttgaacggatatcaagcagcttgttcagcagaggcggcaattttcgggcggcaatgaaaaacagcagcatatatccgaaagcgatcacgattgacatcagcgcgcctccgacagacgtcgcgtctcccagaacaagcccggagacgacggacaagtaaaccgccagaaagatatcctcaaacataatgatgccgagaatcagctccgtttccggattggccgtgcgctttaagtcgacaagcacctttgcgacaatggcgcttgatgatatcgtgatgacacccgccaatacaagcacttccaaaaaggaaaagcccgtgataaagccgtagatcagccctaaactgaaattaatcagaatataaatcgttccgccggcggcgattgaacgtccggatttgactaattttccgaccgagaattcaagcccgaggtaaaagaggaggaacaggacgcccatccgtccgaaaaattcaatcacttcccggctttcgataaacgtcaggtcaatgatgcccgcttggggcgcgtgcggcccgacgagcattcctaaaatgatcaggaaggggatgatcgagaatttaattttattggcgatgacactcgcaatggccacaagaactaatgccgtcccgacttcaaatacgagatggtccataaacagatcacactccgtctctggagaggaagtcttggatcagctttttcagatgctttctttcacctgagaggacgagtgtatcgtttgcttcaaggagcgaatcagcgcccgggtttaaaagctttttctggttatgcttaatgatggcgatgaccgtcacgtcatagttctgccgcacatccagttcgccgagcgtccgccctgccgcttctgcccctttttcaactttaaaccattcgataatcagatcgctgaatgccatttcaatcgattcaagcgcctgcggtttatacaccatcccgccgataatcgcggcaatctgtcttgcttccgcatcatcaagtgaaatgcttgccagaagctcatcagggtcgcggtcatcaaatctgtaaatttcccgcctgccgtcatcatgaatgatgattgtcattttttcatgatttctcgtttcgatttcgaattttttcccgatgccgggcagatcgttttctttaatattcataaaaatccctccggaatatactgtttttacaccgtaaatacagattggcaatgagaaatggtctgatgccggaggtaatttgactggtattgtatcggaatggcgcatgtcctttccattgtggaatcaatgaattgatcaagaggtttgacagataacagggagatcatccgggataacgcaccgtatccttttgacaggccttgcggagcggttttggtttgaaccggcgtctttgccgaatccgtttcctgcgggtaaaccgaaatttgtacatggctgtctgtttctgtcaccaattgggaaggaagagcgacatccgaaggggggaacagcaccataaaaaagctcagtaacaagctgagtatcacatatttcattatcggcgtttttccccccttttgttttgtatatcaatttcactatataaaaatgtatgttcagtttcaaatgatatgcatttttcggtatctgttgaccttgaaaaataaaggagtttcgcttcgggggaaggaatatatcatttgaacaaaatatgtaagcggattcaagggggatgtaaacatgcagtatattcgttatgaagaaaagggaaagatcgcggagattgtgctgaaccggcctgacagttacaacgcgctgaatgaacaaatgctccgggaattggaaaatgcatgcgtgatggcagccgacagtgaggcgcttatcgtgcttttacggggggaaggccggggattttccgcgggcggtgatatccagatgatgacgtctgatcatgattcaggagaatatgaacggctcatgaaaatgatcgaatccattacgctgaccctctatgatatgaaaaaaattgtgattgccgccatccacggagccgcggcggggctcgggctgagttttgcgctgtgcgccgatgtggtgctcgccgaagaaaacgcccgcctcgcgatgaatttcatcggcatcggattggttcccgatggaggaggccattatttattaatgagacgcgtcggtgagatcgaagcgaaaaaactgatttggagcggtgaaaaattgccggctgaaaaagcggtgcggctcaagcttgccgacgggctgttcagcggcggccctagtgagggggcacaaccgtatatcgaccgattgctgcatgcgccgctgtcagcgatgattgaaacgaaggctatttatcagagcctccatatcagccggttaaaagacgttttgtctcttgaacgaaaggcccaggaaaatatgagaaaaacggatgatcataaagagggcatccgcgcctttttagaaaaacggacgccgcaatttaaccggtaaaatacagaagccggaaagcttctgttatctgtggaataaaatcagctttccggcttcatttaccaagcgatgagtactgttctcaagctttttttccttcaataaagcctctccggcggccttcgcctccgcctcattatccgcttcgatccgttcattcagcagcgtttctcccgacgcatggaatgcggtcaatacatattgtcccatcatgtcaccccctttatagaatgatattctgataaagaatttaaaatcctccattaatttttacccattattagtatataatgggtcaaggaaggagttggatttgtgcttacaattgaaaacgtaacgaaaacattcggcagctttaccgctgttgacaatttgaacctgcaaatacctgaaagggaaatgttcgggctgctcggcgcaaacggcgcgggaaaaacgacgacctttcggatgattttaggtcttttaagcctgactgacgggcatatcacctggaaaggacagccggtcaattattccatcagtgaaaaaatcggctatctcccggaagagcgggggctgtatccgaaagtgaaggtgagtgaccagcttgtctatctggcgagattaaaaggaatgggcaaaaaagaggcggaaaaagagctcatgacatggctcgagcggttcggcattacagattacaagaataagaaagtcgaagagctgtcgaaaggaaaccagcagaaaatccagttcatttcggccgtcctgcataagcctgaactgctgattctcgatgaacctttcagcggtcttgatccggtgaatgtcgagctgctgaaagaagcggtcatttctttgaaaaacagcggcgtttccatcgttttttcaagccaccgaatggagcatgtggaagaactttgtgagaatttgtgcattctccagaagggaaaacccgtcgttcagggcaatctgaaagacattaagcggtctttcggcaaaaaaaatgtcaccgttcattcagatgatgacctcagctttttaaaaacgcatgaaggcgtcgtgaaatggaaggaaacaaatgacgggatcagactgcaggtcgcgaatgaaccggtttctcaggatattttccgggccctgcaagggaaaggttttatacggaagttcgaattggaagagccgtcactgcatgatatttttatagaaaaggtgggggccgtttatgaataaattttggattatgctgtttcatacatataaaaacaaaatcgcggcaaagtcattcattatttcgaccgccattaccgttttattagtattagcggtgaccaacctgcaatcgattatatccgtgtttcaatcggatgacggcaagcagcaaatcgcggtgattgatgaaacgggcgggctgtacccggcgtttgcaaaacagcttaaagcggcggatacagacaatgatctgcaggcaatggagacgaaggagtccgaaaaagatgccgtaaagcgagtcaaagacggtgaatgggacggactgtttatcatcagacaagatcaaaaaggaacgataacaggagcatacaaggcgctgaccatttccgatgaatcagcgtataaactgctcaagcaggctttaacccagacaaaaaccgctgtcgaaaccgccaagctcggcatttcggcagaaaaagtcagcagcctctacactccgctggaagtcagcaaagacgcgctggaaaaaggggcgaaatctgaggaagagctcggtcaggtaatggggcttgtatacatcatgctgtttgtcatctacttctcagttatcatgtacgcaagcatgattgcgatggaagtggcgacggaaaaatcgtcccgcgtcatggaaattttaatttcaagcatgccgccgattcagcagatgtttgccaaactgttcggtatcgcgctcgtggggatcacacagtttgcggtgctgattgcggcgggttatctctcactgaagctgaaccctcataatgaggcgtcgtcgccgatcagtgcatttctcaattttacggatgttcccgtctcgacgatagtctatgccgtcattttctatttgctcggctattttctttacgcgacgcttgccgcgtttctcggcagtgttgtcagccggatagaggacgtacagcagacgattcagccgatggtttttttagtcgtcgcaggttttatgatcgccatgttcggcatcggcaatcctgacgccggttttattaccgttacatcttacattccgtttttcacgccgatgattatgtttttacgcgtcgggatgctcgatatcccgttttggcaggctgcggccggaatcgccctgacactggtcactatcgtgatctttgcggcggtcggcgcgaaaatttacaaaggcggcgtattgatttacggaaacgccagcggattcaaagcgattaaacaagcgttgcgcatctccaaaaaataagagaaacagcccggaacagccgggctgtttttttattttgcagaacgtgcattcgtataaaaacggtgctaaaataatggtaattcaatttgcagaaaggggagggcgagatggctgatctgacgtttattcatgccgctgacctgcatctggacagcccgttttacggcatttcgaatctgcctgaaccggtatatgcgcgtattaaagaaagcacatttcacagcgtccgccgactgacggacggggcactccgggagcaggcagatttcgtgctgctttcgggggatctgtttgacgaagccaacagaagtttaaaagcccagctgtttttgagaaaacagtttacgagattacaggaagcggatatccaagtgttcgtcatattcggcaaccatgatcatttgggcggtaagtggacgccgattgaatggccggaaaatgtacatatcttcacctcggatacaccggaggaaaaatccttctttaaaaacggagagcttgcggcaagcatatacggatgcagctatcaagaaagaagcgtaacggtcaatcaggcggcccgttaccggaaaatgaccggcgcgccttatcatatcggcatgctccacggcatgttatcaggagcggaagggcatgacccgtactgcccgtttacgaaagaagaccttgaaaaaagcggcatggattactgggcgctcggacacattcataaacggcaggttctgtccgcccggcatcccgccgccatttaccccgggaatattcaagcacggcatttaaaagaaaccgggcctaagggatattatctcgtccgggcggcaaacggtgagatgtcttgggaattcaaagaagcgcatgatgtgttatgggaggaaattgatcttgatatctccggagctgaacatatgacttcacttctgaaagccgcatcggatacattctccggcttgcgcgcggcgggccgcccggcatgtgtcaggctggtgcttcgcggcgcggcgccccgcttttggacggaggcgcccgcaggcatcgcggaggagcttctttccgctttacaggaggaagaggccgaagaggaatgtttcgtctggccgcttgcgcttgaggatcggacggatgaaacagacaccgtgccgcccgatccgttttttaaagggctccttcaggacatagaacaatgcgcggacatgagcggtgtatttgaagcccttgagcgtcatcccgtataccggcgtcagatggcttcatttacagatgaagagatactggatattaagcggcaggctcaagccgttttaagacgccagatgaaggagcttcagcgatgaaaataacggcgatgcatatttaccaatacggaaaattttccgaccgaagttttcagctgtcagattcttccgtgcaagtgatctacgggttaaatgaagcggggaaaacgacattgatgtcctttatcaaaagcgtactgttcggttttccgaaatcaaaaaaatacgaaccgaaaaacggcggggtttacggcggcactgtggaattgaagcatgtcgatcacggcgctgtcaaaatcgaacggacaaaaggcgctgccgaaaaagtcagagtgtatatggcttcaggcgaaatcaaggacggagaatggctcaaacagcttctctccgatacagaccgggcgctgtacgaagcgatctattcgttcgatgtattcggactgcaggagattcaagcttttaaccgggacaaaatcggcgagtttctcctgtattcgagcttattcgggtcggaagcggcggcaaagcttgacgggcggctggcaaaagaacttgacaggatgtataagccgaacgggcggaacccccgcttaaatcaggagttggatacattaaagcggttcagcgcccagctgaaacaggcggaagctgcggaagcgggctatcacagccttctggaagagaaaaaaagcgccggcggccgtttgcaggatgccgaagcacgattgaaagacataactgaagaaatcaaaacagtaaaatcagcgatagaagcaaagccgctcgcagataaaaaaacagccttggaaagcgaactttcttcttatccggaagcattgaagcaattcccgaaggacggaatgcatcagcttgaaaaatacgaatcgcatctccatccgaaagcggcccgtcttgaggggcttcgggcaaaagcggatgaactccggcggcaggctgagctgctcgctccaaatgaggacttgctgcaaaaagagcggcagctgcaggagctttccggcgagcagcatatgtacgaatcgcgcggcgaacagcttgccgccatccaatcacagatccggcagacatctgcccgcgtttcgtcaggattgcagcagctcggaagacatgaggaagacggcattctttcactgaacaccgattatgaatatgaatggcggctgcaggaagccgtgcagagcgccggacaggcaagagaaagaaaggcacagcttgatgcgatgttcgaacaagcgcggctggagctggaagaagccgaacgaaaacatgccgtgacggcggaaaacattttggaccccgctgtcaggaaagaaaaagaagccgctttacaatcatataagcaaacggctgatacagaaggaaacgaatggcaggcacatgttcagcatctggaaaaacagcgcgccagacaaaaaaagctctttctcggtgcgggcattctgttcattgcgattttcgctatgttaaaggaatggctgcccgccgccctttttaccggcgctctgctgctgtatatgctgtccggcatgcaaaaaccgttgccgtcagaaagaggagggcccggacacaagaaaaagaagccggcgatctctaaagaagcggctgatcttctgcaggaagagctttggcgtgacggccggcaccggcagcagctgattgcggatcaagccgtgcttgaacagaaagaagcggcatatgaaagaatcatccgccaatatgaagaatgggaggcggaaatggcgccgtctgaaaaacaggcggaactttttatgaaggaactggggttttcaggaagtcattcccatcttcttgacgcatatcatgtgatgaaagatgtcaaaaaagaaatccttaacaagcatgagctgaccattgaagcgggccggctgcaaaagctgcaaagagcatttgaggaccgggtcaaaaagctgagtccttcagacggaagggagctgtccgtaaaagaaagactgcacgttttgctggcgcaggcggaacgggcccgtgaagaagcaaaacgaaaacaggcgctcgaaacggatctgctgcatgcacaagagcaaatgcgtgaattaaacgaagaagttcattactacgaacagcaggtcaaacagcttttcatggcggcaggcgcaaaaaaccgcgaacacttttgtgaactcgccaggctgaatgaaagccgccgggaaacagagcggcagctgcgcgaaatcaaaacgcacttgtccggcataggcggaaaacagctggagccgtacatgagccgcacagtgtccgaacttgaacatacagtcgttcagaaggaaacaaagaaaaaaacgcttgaggaaaaaaacgcgcagctccgtgagcaaaccgctttattaacggtgaagcaagagcagctggagtcctcggggcttgtatccgatttaaaacagcagacagaaatgcagaaggagcgcgtgaaaaaaaccgctaaagagtgggccgcattacagacggtcagacacattatcagggaaaaaatggagcggcataaaaaagtgacgcttccccgtctgttagaaaccgccggtgcattatacggaccgcttacggacggacgctatcacaaattgtatttttccgaggctgatgattccattatggtcatgcggaaagacggaacggtgttttctgcaggcgaactgtcacaggcggcgtgcgagcagctttatgcggcgattcgttttgcccttgcgtcagagagggaatctgcggtatcactgccgtttttacttgatgacagttttgtccattttgacaggcagcggctgcagcggctgtttgatgtgctgaatcagctttcagaaggcgggcggcagatactttatttcacctgccatgagcatgtcagccggtcttttcacagcggacaagtcatgcggctcctgtcataaaagagtttattttcaaaaaagaggtatgtgctatactggtattatgtaagatatggagggagcttttaatagaatggcaaaaggtattatgctgcacgaggtcggcgagcaggtcgatcaatactttctgattaaatcttcgactaaaggaatcgcaagcaacggaaaaccattcctgacgttaatgctgcaggaccaatcgggagatatcgaagcgaagctgtgggatgccaagccgactgatgaagtaacgtacgcggcgcagacgatcgtgaaggtgatcggagatgtccatcactatcgcggacgaaaccagcttaagctgagaaacatccggccggccggcgagaacgaaaatgtcagcattgatgattttctggaaacggcgccaattccgaaaaatgaaatgatggaaaccgtcactcaatacatttttgaaatgaaaaatccaaacatccagcggatcacaagacatctggtcaaaaaatatgcggctgagtttatggattacccggctgcggctaaaaaccaccatgagttcgtctccgggctcgcgtatcatgtagtgtccatgctgaacctggcaaaagcgattgccgatctgtatccgtctcttgaccgggatttactgtatgccggagtcattctgcatgatctcggcaaagtaaaagagctttcaggccccgtctccacaacgtacaccgtggaagggaatctgctcgggcacatttcgatcatggtgacagagctttcaaaagcagccgaagagcttcagattgacgctgaagaagtgctgattctgaaacatttgattttaagccatcacggaaaagcggaatggggaagcccgaaaccgccgatggtgaaagaagcggaaattctgcactacattgataatctggatgcaaaaatgatcatgatggacagagcgctggaacgggtgaagccgggcgaatacacagagcgtgtatttgcgcttgaaaaccgttctttctataaaccgactttccatcaataagataaaaaggccgattctctatgatcggtcttttttacgttcagctctcataacttgtctttatcaagcataacttagaataaagactctgggtgaaaaagggaggaaaccgacgtgctattttttccttggtgggtatacctttgcattatcggaattattttcagcgcatataagcttttcacaacagctaaagaagaggaaaagcttgaccagtcgtttattgaaaaagaaggaagggtgtatattgaacggatggaacaggaacgcgagcgccgtatggcggcgcccgcaagtgaaaacggggatgcggaagaaaactccaatcattccatcgcataaaaaaactgtgcggctcgccgagagcccgcacagttttttttatttagattcagaagatgttgaagtgttaaacgtgtcttttaagtctttgtcttccacttttacgtcagcttttttcatgactttttgaattgccgcctgtacagctgatccgtcttttaatttctgcttaagaacttcttctttcagttcttttttcatgtcatcatatttgccgcgttcttccgtctttttgatgatatgataaccgaattttgttttgaccggatcgctgacttgtccgactttcaggccgaatgcagctttgctgaatgtttcatccattgattttttatcgaaccagccaagatcgccgccgctgtcttttgagttgtcggttgagtattctttcgcaagcgtttcaaacttctcgccttttttcagctttttctccacttcgtcagctgtctttttgtcagcgacaaggatgtggcttgcgcggattttaccttttaagccgtcgtaatattctttcgtttcggagtcagtcactttgatgttgtctttcgccgctttttgtgcaagcagttcgtacttcacctgatctttcaggtaatcttcgccgtactgctgtttaagggcgctgtactgatcaccgagctgcgttttgtactctttcagcttgttatcgatttctttatccgttactttgtatttttttgctaatactttttcttgtacgagctgtgtcagcacacttgcacccgcagtttttttcatgttcgtgtagagctcgccttttgttacatttccggcatctgtcttggcgattacgtcgttgtcgccgctgctgcaagcgctgagagccaggacgctcgttgccgtaatagctgctatcgcgattttcttcattcctttaaacactcctaatcatccaaattaaattgcatatgcgtatcataacatattgtggctttctgtaaaaagattttaaataaagggcattcgtctagtcaaactttttcctgatacatacaaatatattgatcatgaaaaggaggtaatgaaccatgggcggaggatattcaaacggtttcgcgctgctcgtagtactgttcatattgcttatcatcgtaggtgcagcttacatttgctaagcgaaacggatcgctttttctaaaagcggtccgttttcttacccgggcgcctaatcgtttcagaagtaaattgcatatgatgtaattggaaaaataaaacgttttgtaggaggtgcttttggagatgggtgaagtatttgcaggcggttttgcattattggttgttctgttcatcttattgatcatcatcggcgcttcttggctttattaagaaaaaaatatggctgtcggggggtcagacctccgtcagccatatttttttgcctgtttacacagtaaaggagatctcgacgaatgaagagatcagtaaaattaaaatagatacattaataaaacggaataccttatcctgccggtcttcaggaatctctctgacaaggcataatgtatttgtgagcctgtttatgaaataaagaataaacagggcagccacgataaaatagaataaaatgatgggagattccccctctctctgaactgctcccatattacattaccaaatatttattaaaaaagatagaatgtaacctgaaaaatcagcgggacatcaagactccggcactttttttactaaaatatcaaaaccgtcggattcctggtcaatcagacatgatttgggcgctttgaccagatggagcgcaaacagaagatcaggcaggcaataccccgcatgaatgctcgaaatcatataaaagtaatgagcgtgtctcggaaatgccagtccggcataaaacaataacggcgtaatgaataaaaacgggctgatcgttgaaatcagcatcgtcgttttcggtatgcctttccatgtcggcatccgcaagaagtacattttcatttccttttttctttttttacagatcatcggcaggacatgtatgactttatgtacaaataaagtaacaacgagcagaacacaaaaagcaaacacgtgcccgtcacttaaactgatattcggacgcagcagcccgaatgccaagaagttgcatataaaaaacaggatcataaaacctacagcagtcaataataaacgaaccgcaccataatctttgatcagattaatggttttccagcaattcatcagagtcatccttccgtacaaagatggaatacaatctcaaaataatttactctcttcaggagaaaaaatcaatccttttttaaagaaaaaaataaacctggaaagagaagaacagaagagctcggtgaaacatggaaatgtacggtttaacctttcttctccattcattatcagctaaaataagattaaagatagaaagaagtgaaacggatggattcaatggatcagcgtatcgggcgtttagaatattacatacaattgctggtgaaaacggtggatatggataagtaccctttttatgcgatgatgattgaaaaagggctgaccgaagaagaaggagaagaggtcgggcggatctgccgcgaattggaggacgagctggagtcgcaaaaagcgcaaggctttgtgacgtttgacaagctccttgcgctttttgcgggacagctgaacgaaaaattagatgttcatgaaacgatttttgctctgtatgagcaggggctttatacagcgctgatggaagagtttattgagattatgaagcactttgattaactgttgatcggttccagctcttcagccgtttcatggacagccgattcgtccgtttttttcttcagccttccgtcttcactttcaaaatcattgtttatgtttgtcaatgatttctcgaatatctccataaaatcttcgccgtaaatgtggcggatgacacaggttaattcttcaacctcaggaaacttcccgaataagtggtagatcggctgtgagcctttaaacaccgcgttcctcgacggatcaaactcctcaagcaggctttcgaatacattttccccttcttcagttaactgaatgtacgtgttccgtttatcattcagccgcttggaaaatttcagatatccccgttcttcaagcttttttgaaaagttaaatgcagttgatacgtgcataacgccgaatttggcgatttctgaaatagaagctcctttaagctgataggcaatccataatatatgatgctcattaatattaaggtcgtacggcttcagccaattctgccagtctttctcgatagatttccagagcgctttggacagctgcgccattttttgggtatagattaaagcttcttttagatcgtaaggcggttcaacacgattcaatacagatcacctgcttcacattttcttttcctctattatgccaataaaataaagattaataaagatgaaaatttaagaattttataataaattcttaatcctttgctgggaaaggctttaaaccgcaaaaaaaagtgcggaacgcaataggtccgcactttttttggttgtataggatattagttttgtaaggttttctccagctgtctgattttctcttcgatatcagcgatttccttttggagatcctgctggtgcggcttgatttcctcctgccaccttttaatgctggtctgaagctctccgcctacgtctttaatgacttctgcgctttctttcgccgtttggacaagctggtccttaagcgccattccgtctttttttaaccgtttgattgtgtcctcaattgaattgcaattctctttgattttgccccgcagctcttttccggatgaaggagccgagagtaacaccgctgcgcctccgatcaatccgcctacgaaaaggcctgttaaaagggaacgtccgtcagccatttgaatcaccccgttttttttctcataacttttatcatttttgttcagaagaataaacttctatacatagcttgctttattttagcatattttttaagggaaaaggagggagaaggttgtctgtctttatgattgttttatcttgtatggctcttgtctttgcggcgggcgccgtttattacctgaaactgctcggccaggccgcttcttatccgccgaagcgggtcgtccgccaaaaggccatcgtctgctcagcaggaaccgccctcgcattgttccttatctttttcacaaaacttctcgtataaaacatgctgaaacacattaaaaaacctcttccggccggaagaggtttcggtatgcggttatttcaccgtttcaatcatattggaccgttttaagatcgtctgcacaatcggatgcataatgataatggcgatcgtattcagcgcagccgccggaaggacgaccgcgagcaccaatgcggtgaatccgcccggcaggccgacaatcagaagggccagcgccaaaaagagcaaaccggagatgaaggtgccggctatcgtaatgacggcggcggccgctgttttcacgctctttttcaccaaaagcgccagcgcgagaaacagaaacgccgttaccggtttttcaatgatattcggaagctgtccgcccggaaaagatgtcgtgagtgcggaaatgatacccgttacaatcccgatcatcagcacgttctgcacacgggggaataacagaatacccataaacatcatcacaagcatcatatcgggtttcattccgaataataccggcggcataatggaatgaagcaccgctccgattgccgcaaacagggccataatgactaattcttttgttttcatactaagctctcctctgctaagctttttcgccatccaataatatgctcgtcatttattgcgatggccggaaaaattgatatgcaaacagtatatcaaaggaaccgttatgttagaagaaatttattcgttttcctgctggaactttctcataaactgagccagtttttcacaatcagccaggctgacggcgttgtagatagacgccctgcagcctccgactgagcggtggcctccgagtccgatcattttagccgctttcgcttcttcaacgaattttttcgtgagactgttgtcgcggagggtgaacgtgacgttcatgtgagaacggctgtcttttgcggcatgccccgcgtaaaacccgccgcttgcgtcgattgtgccgtacaggacgtcggctttttcctgattgcgccgttcagccgcttcgacaccgccgttttcagccagccattcaaggacgaggctcagcatataaatcgcaaatgtaggcggcgtattatacagtgaatcggcttttgtgtgagtggagtatttcaaaattttagggacgttggcgttttcgttttcaagccatgattttttcatgatgacgaccgtgacgccggacggcccgaggtttttctgggctccgccatagatgacatcaaacgttttgacatcaatttttctgctcaggatgtcgcttgacatgtcggctacgagcgggatcggtgaattcgggaactctttccactgcgttccgaaaatcgtgttgtttgacgtaatatgcaggtaggcgccgtctttgattcctgagaggtccgcttccggtatgcggttgtggtttgaatctgcgcttgttgccgtgacggatgtgtttccgaacagtttcgcctcggcgagtgctttttcagaccatgcgcctgttacgatgaagtgcgccgttttttccggcgttaaaaagttcatcggcagcatggagaattgaaggcttgcgccgccttgaagaaataaaatatcataatcgtcaggaatatccatcagttctttcagaaggcttttggctttttggtgcaccgcatcatattccgtgctccggtgggacagctccatgacggacatgccggtatcattgaagttgacaaattctttttgtgctttttgcagcacatccagtggaagggctgcgggtcctgcattgaaattcgttgtacgttccatgtttacgatctctccctgttttccgctttagtgtaagaaataatacaattatcctatcacaattttttgatttttttgatatgaaaaaatataattttatgttttttgtgtttccggacgcaaaaaaacctcatctttaagatgaggcaagccgttttctgacggttgaagcgatctcatgaagatcgtcaggcgtatagtcttcggcgtgggtcttccagacagccccgaaaccgtcgccttttccgtaacgcggaatgatatgcatgtgaaaatggaacaccgattggcccgctttttcaccgttgttattgagaatattcagcccgatcggctcgaattcatcgcggatggcgcgtgcgattttcggcacggcttcaaaatattctttagaaagctcaggcgtaaactcgtacacgttttcgatatgtgttttcggaatcacgagcgtatggccttttgtgacctggctgatatcaagaaacgccacgacgtgttcattttcgtatacttttgaagacggaatgtcaccggcaatgattttgcagaaaatacaatcgtccgctttgtgcatagatgggtttcctccctgaaaagaaatatatgtatattctcatcgtaccacaaaaacggccaaaacaaaaaacaggatgaacggctgcgcgttcaccctgatgcagaagtacgaagctttatcacagaaaattgaatatgccttttgtaagcacctcatttgtttttaaaatgaagacttatgggtctgcttaatcattcctgggacaaacacctcatttgattatttcatcatgaatgaagaacatcatcaaagcagtgtgtgaagaaattgtaagcacaggacatattgattttcatccaactgttctaagacgtcttttataaacacctcattttcagttgattaaagctgtttccttctacatatattatgatgtccgccaaaacgataactatgcacacttttcacgtgagaaaaaaagggaatcgtttcaaatcagactttatttttggtactatgaagaaaaacgaatcagaaggggagaaattatgtctctgctatcggtaaaagacttaaccggcggttatacgaggaacccggtcttaaaaaatgtttcattcacccttgagccgaaccagattgtcggactcatcggattaaacggcgcgggcaaaagcacgacgatccgtcatattatcggattaatggacccgcataaaggctcgatcgagctgaacggcaagacgttttcggaggataaggaaagctaccgctcgcaatttacgtacatccccgaaacgccggtgctttatgaagaactgacgctcaaagagcatttggagctgacggccatggcgtacggcctttccaaagaaacgcttgaaaaaaggcttcctccgcttctgaaagaattcagaatggaaaaaaggctgaaatggtttcccgctcacttttccaaagggatgaagcagaaggtcatgatcatgtgcgcgtttctcgcggagccttcgctttatatcattgacgagccgtttctcggccttgacccgcttgcgatcaatgcattgctggagcggatggacgccgcgaaaaaagccggatcaagcgtgctgatgtcaacgcatatcctggctacggcagagcgctactgtgacgctttcattattttacataacggcgaagtgcgggcaagcggcacactggaagaactgagagagcagttcggcatgaaagacgcagctcttgatgacttgtatatcgaactgacgaaggaagacgccggccatgaataatatgtctactatttggcagtcccggcttgaagagcatataaaggaaaccagaatgtatatgaaatatatgctcaatgatcatctcgtcattgtgctgatcttttttattgccggcgcggcgagctggtacagcaagtgggtcaaagacattcccgttcattttccgtcattttgggtgatggcggtgctcttttcatttgtgctgaccggttcatacgtccggacgctgttaaaggaagcggacctcgtgtttctgctgccgcttgaaccgaaaatggggacatactttaagcattcatttaagtacagctatctgtcacagctgtttccgcttattgccctgtcgcttgtatgcatgcctctgtttttcgctgtaagtccgggggcgtcgcttgcgtcgtatgccgccgtatttattcagatgctggcggtaaaagcgtggaatcaggccatggagtggcggatgacgtttatgaatgacagaagcatgaaaatgatggatgcggttatacgctttatctgcaatatgctgcttttatacttcgtcttacagtcgttttatgtgtacgctgccgccatctatgttgtgatggccggcctttatgtgtatttcacatcggccgcaaaacataaatcattaaaatgggaagcccatattgaatatgaattaagaaggaagcagcggttttacagaatcgccaatctgtttaccgatgtgcctcacctgaaaaaacaggcaaaacgccgggcgtatctcgactttttgctcagaatgattccgtttgaacagcggaaaacgttctcctatatgtatgcgcgggcctttctgcgttcaaatgattatctcggcattcaggtcaggctcacgattatttttatcctgattattatgctcgtttccgccaatccgtggataacggcggcgttaaccgtatttaccgtctttataacggggatacagcttctgccgctgttcgggcattttcatcatctttctctgcaggagctttacccggtcaatcagaaagcgaagctgcaaagtttcttttcgctgatgaaatcggcattaaccgtgcaggcgctgctgttctgtgcagcgtcagcttatgccgcgggagtcagcggggcgctgtatgcggctgttgcttcagccgttctgatttttgtgatcatgccttcgtatatgggcggaagattgaaaaagtacggcaagctgtaatcaatcgggtttttgaaacctcaatgaaagaaggagacacagatgaccgacgatcagcagctgatacaggaagcactgcaatggaaagcgcgttttttgcgcaaagattccatgcttgaacgcttttctaaaggaatgcaggcgaaaatcaatgagcggattcccgataaaattcatgccgtcatcacagaaagcattaaaaaaatgaccgaagcaacaatggcgggttcaaatctggtgaaaagcaagcgggatacaaacggtatgacgcttgctgaaaaagatgccctcgccagacaaaccgtcgcatcgtaccaaaaggtcgcggcagctgaaggtatcggtacgggggccggcggaatttttttagggatggctgattttcctttgctgctatccattaaaatgaaatgtctgttcgatcttgcctccatttacggttatgatgtgaaagacagggatgaacaattgtttttgctgtttatttttcagctggctttctcaagcggtgaacagcggaaacgcatatactcaatgattgaacaatgggattcgaaaaagcatgatgtcgattggagagtttttcagcaggaataccgcgattatctggacgtggtgaaattgtttcagcttttgccggtcgtcggagccgccgtgggcggagcggccaattataaactgctgtcacagctcggtgagacggcaaggcacgtttttcatttaagaatcacagcagccggtacgtaatgtaccggctgtttttttatgttttttatgtcagcgggggtagcttaccgcggcgccgataagcaccttggcggccgtcagcatcgctttttcattaaaatcaaatttcgggtggtgatgaggataaatggtttccgcattttctaaagcggcgcccgtaaagaaaaaagcgccttttgtatgctgcagataataggaaaaatcctctcccgccatctgcggctctccttcaacgactttcgtaacgccgtctgtttccgctgcggctgccgcagcgtgcgccgcttcctcaggatgattgacgacggcgggatagccgcgtttgaaacgatattcataggaagcggagtgcatggagcagattccttttacgacggcttctatttctgcttcgagcaggctgcgcacactttcgtcaaatgagcggacggtgcctgatatgactgcctgatcggcaatcgcattaaacggattttcagcggtgaacgagccggctgtgatgacggccggctgcaccggatttacccgccggctgacgatatgctgaagagccgtgacgatttgtgagccgattaaaacggcgtctttcgtatcgtgagggatcgcgccgtggccgcctttgccgatgactttaatcgtaaaaccgtcagcggcggccattactgggcccgggcggcataagaccgttccgacgggttcagtcgcccataggtgtgtgccgaaaatggcatcgacatgttcgaggcagccgtcctcaatcattgcttttgctccgccgggagataattcctcagcgtgctggtggatcatcacaaatgaccctttcagtttttcccggttgcggtacagcacttttccggccgcgaggagagccgccgtatggccgtcatgcccgcaggcgtgcatgacgccgggaatttgtgaagcatagggcacatctttttcatcctgtatcggcaaagcgtcaaaatcagctctgagtgccacggccggtcccggttcaccgccttcaatacaggctgtgacaccgttgcccccgacattcgtccggatgggaacgccgagcttttcataaaatgaggcgatgaacgccggtgtttttttctccttaaaggatggctcgggattcatgtgaaggtgacgcctgatttcaaccatttcctcatacagcccgtcaagctgagcgtttaagcttttttgaagtgtcgttaacgtcaaaagcgatgccccctcgtctgcttttcccatgattgtatagaaaatatcagaagatttcaatccttttgctacgggagaatgacgatggcggcgatcgttgtgacgactagcccggccgcaaccgggataaagtttttcctggcaagctcaaacggatcaactttacaaatagccgcagcggggatcagtgcccaagggaccaatgttccgcccccgacccagatcgctgaaatctggcccagcgccgttaaaacggccgggtccgtatgaagcgcggcagaaaacagctttgccatcgagcctgcaagagatataccggaaaaccctgacccgtcgagcccggtaatcgcaccgactgctgccagggcgatgccggcgaattctccggacatcggaaaagaatgggacagggccaatccgaggtcattgacgatccccgcagatcctttcggcagcggggtgttcaaaatacttttaaaacccgcgtcaccgagataaaagaaggccgcgatcggaatgacggggccgaatactttaaagccgaattgaaaaccgccgataaaatactcggtgatcttttctaaatgccgctctttatatacaatgaaatgaacgatcaggagaatgccgatcgcggttcctccgacgagtgccgtcgcctcgtttccctgcagacggtatacgatcatgcagataatatcggcgagaaaaacaagcggaatgaaaaccgccaggatcaccctgagttttttcggcaggtacatacttgtgtccaaagaaccggagctgtccaaggagaggggggtcttcgttttttttcgatcccgcatgatgaggaagaaagcggtgattgtcgtcgttaaccccatgatcaaaacgagcggaatacttgcctgcatgacatcgcccacgggaatgcccgcggcatcggccgttaatttcggggccgcctgaatgacgtaatcccccgataaagcgaatccgtggccgaacaggttcatcgccatagccgcagcgatcggagaaaggcccgcccggatcgctgcgggaagcagcacagcgccgatcagcgccacccctggtgacggccagaaaaaaagagagatggcaaacatcagacagccgataacccaatacgcgacagccggccctttcatcagctttgcaaacggagaaatcatcgcttcattaataccggtttcggtcaaaaggccgctcatcgccacgataaaacaaatgataaaaattgtcggcagcaattctccggcggcatacgtgaagctgtgaaacaggctgctgaccgaagcggagaatgaatgcgtcgtccatagcgcaatcacaaaaatgccggcgagtgaaataaaggttgtatcttttctgagaagcataaaaacgataatggccgcgataaaagcaacataaagcagatgtaccgagtagacgccgatccccaattgaaccactccgtttataaataggattgctacaggttattcataggcgggcggaaggtgcaaagaacgaagcgtaaaatcgggacattaaaaaagccggagaatctccggcggttttttagtctattgcgtaataagcggttacataagacggccgggagaaaatagacgtcgtgtcgatgccggcagatgttccgcgttttttatgagcttcctgataagagtttgactgctgccaatcctgaaaggctttttcctcttcccacagggtcaaaatgacatacgtatcgccttcgagcggtcttaatacgcggatggcttgaaaaccgggttcattttccactttgccggcgcggtttttaaaccggttttcaaacagcggacggccttcctgggtaacggcgatgttgttgaggacggcgtagcccggattttttatttccccgacgctgtcgatgctttcataggaatggggcgcctgaaaaacggtttctccatttgtttcatgaattaaaaccgcattatcctcaccttgcatcagcaccatattctcactcgggtgtttctttgcaatcgtctttaaaaaatcggctgtcccgtatgtaatataaaccttcatatcagccacctcctgcttgctagtatatcaaaagagtggtataagtttctattggcgactcattctgacataattcgaaacaatatttcccatactacaagttaagaaaggcgaggtgacttatgctgaaaaagaaaaaaagattctttattccggctgtaattgcggcggcaaccgcttttctcgcgttaatcggatacattatcattatatttctcggccattatgtcatcgatgaaaagaaattaatactgcacgcatcttcaaaaatcgtcgatcaaaacggtgatgaaatcgcgagcctctatacggaaaatcgcgagccggtatccattcagcaggttccggaagatgtgagagatgcctttatcgccgttgaagataaacggttttacgaacatcacggcattgatgtgaagtctgtcggccgggcggtgttccgggatgttttagcaggcggcaaggtggaaggcggaagcacgatcacccagcagctggcgaaaaacatttttctgactcatgataaaacatttttgcgcaagacgaaggaagtcattatcgccatcaatcttgagcgtgattacagcaaggacaagctgcttgaaatgtacctgaaccagctttatttcggccatggcgtttacggcattcaagccgcgtcccactactactttaataaagaagtaaaagatttaaccgttgcggaaggagccgttctggcagcgattccgaaggcgccatctctttattcgccgattcagcatccggataaaaataaagaacgccgcgatacgattcttgcaatgatgaacgaccaaggctatatcagcgccaaggaagccgtcagagcccagggccggacattggggcttcatgtcaagaaaacatcagaaacgccttggtttgacagttatatcgatcttgtcatcaaggaggcggaatcccgttattcgatgtcgggtgaacagctgcttcaaggcggctatacgatccggacgtcacttgattccaagctgcagaaaacggcatacaccctcatgaaggaaagcggctattttccggggacggatcaagcggcagagggaagcgccgtctttattgataataaaaccggaggcgtgcgcgcggcggtcggcggacgcgactacgtgacaaaaggatacaacagggttacggcgaagcggcagccgggctcaacgtttaagccgattgccgtatacggtcccgccatgcaggaagacaagttcaaaccgtattcgcttctccaagacaaactcacgtcctacgacgggtatgaaccgaaaaattatgacggacagtacaagggggaagtgacgatgcaggatgcgatcacttacagcataaatgcgcccgctgtctggacattgaagcagatcggcgtagatacgggaaaatcgtatcttgagaaaaacggtataaacatttctgacaacggactcgcgattgcgctgggcggtctgtctgaaggcgtcaccccgcttcagcttgccggagcttatcatacctttgcggcaagcggaatgtatacgaagccattttttatagagaaaatcacggacgaagacggagaaacgttgtccgggcctaaaaacggcaaaacgcgcgtcttcagcggacagacggcatggaatatgacgagaatgcttcagcaggtcgtaaaagaaggaaccgcttcacaaggcagctatcaaggtgacctggcggggaaaaccggcacgaccacatttaccggcgtccccggcgcgacaaaggacgcctggtttgcgggatacactcccggactgacgggagccgtctggatgggctatgacaaaacggataaaacccattacctgaaaggcggaagccaatacccggtcagactctttaaagatatcgttacaaaagcgggggaaaacggccggacattcaaaaagcctgaaaatgtgaaggaactgggcagcccgattgagctggaggcggtaaagtccctgtcggcccgttatacatttaaggcgatgggactgattacggttcaattaaaatgggatattcaaaaggatgatcgggttgtttaccgaatatatgagaagaaagacggaaaagacaagcttctggattcggtgaaaggaaaaggcagctttgacataccgtacgccaatctgttttcaggggcttcatacaaagtcgttccatataattcacagacggatcaagaaggagagggaacggaatacgttcagccgaagcttttttcttcttaatcatgaattcggcgattttttgaacattaagcctcaattctatacgcttttgaaaaaacaaggtatagtgtaatgggcgaagaacacgaacgtatggttgcaggaggaaaggtggaaattcagatgagtaaacgagaagcgtttaatgatacgtttttaaaagcggcacggggagaaaagacaaatcacgtccctgtctggtacatgagacaggcggggaggtcgcagccggaataccgcaagctgaaggaaaagtacggcttagtcgaaattacgcatcagcccgagctgtgcgcgtatgtgacgaggctcccggtcgagcagtacggagtggacgctgccattttatataaagacattatgacgccgcttccttatatcggagtggatgttgaaataaaaaacggaatcggcccggtgatcgatcagccggtgcgctctgctgcggatattgaaaagctcggcgaactgaatcccgaacaggatgttccttacgtgctggaaacgatccgattactcgtaaacgaacagctgaatgttccgctcatcggtttttcgggagcgccttttacgctggccagttatatgattgaaggcgggccttctaaaaattacaacaaaacaaaagcgtttatgcacagtatgccgcaagcgtggcaaatgctgatggacaagctcgcggacatgattatcgtttatgcgaaagcgcagattaacgccggcgcaaaaaccattcagatttttgattcatgggtcggcgcgctgaaccgcgaagattaccggcagtttataaaaccggtgatggacagaattttccgggagctttctgcagaacaagttccgctgatcatgttcggcgtaggcgcaagccacctggccggggattggcatgaccttcctcttgatgtcgtcggtcttgattggagactcggcatagatgacgccagaaaacaaggcattacaaaaacggttcagggcaatcttgatccgtcgcttcttcttgcgccttgggaagtcatcgagaaaaaagcgaaagcgatacttgatcaaggcatgaaagcggacgggtttattttcaatttagggcacggcgtattccctgatgtcaatccggaaacgctgaaaaagctgacggcgtttgtacatgaatattccgctgccaaaaaaacggaacaatcttcctgagcagatcgttggttataagtagattttcctgtcaaaatcaaggtagacagaccatcaaaagaggtgtttaacaaaatgagcagcaaaaagaaaatgggacttcttgtcatggcttacggaacgccttacaaagaagaggacatagaacgttattatacgcatatcagacgcggaagaaagccggagcctcatatgcttcaagatttaaaagacagatatgaagcgatcggaggcatttctccgctggcgaaaatcacgcaggagcaggcggagaagctcgcacagcgtttaaatgaaatccaggatgatgtaacattcaaagtgtacatcggattaaaacatattgaaccgtttattgaagacgcggtggcggacatgcataaagacggcattacagaagctgtcagccttgtgctcgcccctcatttttcaacattcagcgtccagtcatacaacaaacgcgcgaaagaagaagcggagaagctcggcggcttgaccatcaagtccgttgaaagctggtatgatgaaccgaaattcgttgattattgggtcggccaggtgaagaaaacgtatgaatcaatgccgaaagaagaacgggatgacgcgatgctgatcgtctcagcgcacagccttcctgaaaaaattaaagaatacggcgatccgtatcctgaccagctggaggaatccgcaaaactgattgccgaaggcgccggaattaccgaatacgcagtcggctggcaaagcgaagggaacacccctgatccgtggctcgggccggatgtgcaggatctcacgcgcgagctgtatcaaaagcatccttataaagcatttgtatacgtgcctgcaggcttcgttgccgatcatttagaggtgctttacgataatgattatgaatgcaaagctgtgactgaagaagtcggcgcaagctactatcgtccggccatgccgaacgcacagcctgaatttatcgacgcgcttgcagcggtcgtgctgaaagagctggacaagtagaattaaacggtaaagaaggcgataaaaatgagtggcgataaaaaacatctggtcatcatcggcggcggcataacgggattagccgccgccttctacatggaaaaagaaatcaaagaaaaacatctgccgcttgaggtcaccttgatcgaagcaggcccgagagccggcggcaaaattcagacggcgcataaagacggctacatcattgagcggggcccggattcttttttggaaaggaaaaaaagcgcgccgcagctcgtcaaggatttggggcttgagcatctgctcgtcaacaatgcgaccggacagtcttacgtgctcgtcaacgagacgcttcatccgatgccgaagggcgcggtgatgggcattccgaccaaaatcgctccgttcatctccaccggtttattttctgttcccggaaaagcgcgggcggcgcttgactttgtcctgcctgcgagcaaaccgaaggaagatcagtctctgggtgaatttttccgcagacgcgtcggtgacgaagtcgttgagaatttaatagaaccgctattatcagggatttatgccggagatattgataagctgagcctcatgtccacgtttccgcaattctatcagactgagcaaaagcacagaagcctgattctcggtatgaaaaaatcgcgtccgcagccttcgggacagcagctgacggccaaaaagcagggccagtttttaacgctgacgacagggcttcaaacgttggtggaggagctggaaaagcagcttacgctgacaaaggtgatgaaaggaacgaaagtcacccatatcggccgcgaggagaaaggatattccgtgacgcttgataacggcaaagtgctctatgcggaaggatgcatagtgacagccccgcataaagccgcggcgaaaatgctttctgatctgccggcggtttcatgtctcaaagacatgcattctacgtccgttgccaacgtcgccttaggttttcctgagggagccgtcaagatggagcatgaaggtacgggcttcgttatctctagaaacagcgacttctccatcacggcctgcacatggacgaataaaaaatggccgcacgcggcgccggagggcaaaacgcttctcagggcgtacgtcggaaaggccggagatgaatccatcgtagatctttcagataacgagatcattaaaatcgtaatggaagatttgaaaaaagtaatgaaaatgaatggcgaaccggaaatgacctgtgtgacccgctggaacgaaagcatgccgcaataccatgtcggccataaggagcgcatcaaagagttcagagatgcgctgaaagcttcctatccgggcgtatacgcgacgggcgcatctttcgaaggggtgggcatccccgactgtatcgaccagggaaaagccgccgtatatgattcactggcttatttatttgaaacgtaccagcctccgttatcgtaaaacggaggtttttttgcatgttcccgttctgtaaagggaacaccaataaagagaaaaaacatttgaatcttctttgcgactgtgataagttatcttatgtacaaaatgactaaaacgttcaaacggtcaatttaacgaggtgggaaacatgtccgtcgatcggaaaaagctcattctggaagcggcaacgaagtcttttacacaattcggctacaaagcaacgacaatggatctggtggcaaagcttgcaaatgtggggaagggaaccatctacacgtttttcaaaaacaaagaagaactgtttgatgatattttcaccactattttaagagaaatgaaggaacacgcagacgaagcgatgaaaccggagctttcatttcacgaaaatgtccaccgggcgcttgtcgcgattttggaattcagaaaaacacaccagctgactattaaaatttttcaggagaacgccgagattggtacaatagccgttcaggatgtcattgcgaaaatggagcgggccattctgtcatacattaaagaaaagatagaaacagccattgaaaacggaagcattaaaccgtgtgatccggaactgaccgcttttgtgatgctcaagctctacatcgcgctgatatttgactgggaaaaaaaccatccgcctcttgaaaaagagacgatcgccgaattgctggaaatgtatgttggtcaaggattatctaaataatagatgatccttcactttttaggtgccgtgaccgttttgtcaaatgagtcagtttgcggaaggaggcaacagggttgaatacaataaaaagccagtggaaagacattgtaacgaacaagaaactgttaatccccatcattgccatattattcgttccgctgatctacagcggagtgtttttgaaggcgtactgggacccgtacggcacggtggatcagctgccggttgtcgttgtcaaccaggataaaggggcggactacgaagggaaacatcttcagatcggtgacgatcttgtgaaagagttaaagaaaaatgataattttgattggcatttttcaagcgatcttgatcaatcgttaaaggacttattaaatgctaaatattatttattggtcgagattcctgaagatttttcgaaaaacgccagcacggtaatggataaaaatccgaagaagctggatctgaaatatcatacgaatgccggatcaaactatgtcggcgcgacaatcggggaaaaggcgatcgacaaactgaaagcctccgtgtcgaaagaagtgacagagcaatacgcaaaagtcatttttgataactttaaagatattgccaaagggctcggcaaagccagcagcggagccaagaaaatagacgacggcacgaaaaacgcgaaagacggcagcgccaagctgaaggaaaatttagcgaagcttactgaaagcaccgccaccatcagcgataaaacacagcagcttgcagacggagcggcgaaagtgacaagcggaattcaaacgcttgacagctctatcgcaaaacttcagagcgcaagcgccgaaattcaagataaatcaggacagattgcttcaggaggaggccaagtggccagcgggctgaaaacgagccttgacgcacaaaagcagcttcagcaaaagcttccggatttaacgaatggattaagcgcgttaaacagcaaggcgcaggaagtgtcgcaaaaagcggcggcatttgaagatgcgatcaattcagtcaacctgtcagacattgaaaacgcggttgggcagctcgagcagactgaaaaggacctgcagcagtttaagaagaagctttctgatctgaaaaacaacctggatgcccgggatgacgcggtcaaaaaggtgattaaggacagtgatttcttaacggatgagcaaaaagcgaaacttgttcagctactgaatgagaagcttccgaaggctgaccttccggatttagacaatatcgtcagccagcttccgtccggcggagatatccagcttccggatatgtcagtcataaaaagcgcgctggcagatgtaaaagcgaaggctgatcagctgaaagcactgcctcagtccacatcgaaactgtataacggcgcggcggcggtacaagacgcgattaaccagctgacggccggaactgataaattgtacagcggagcgcagaccgtctttgaaagccaaaacaaactgacggccggcatcggcgaatacaacagcaagttcggacagcttaaatcaggatcagaagcgttagtgtcagggagcggccaggtgtctggcggcttaacgaaactgctggacgcgcaaaacaaaatccatgacggctcgtccaaaattgagcagggtcaagcgtctctcggcaccggtttaagcaagcttttagacggcaccgggcaattgtccagccagctgaaagatgcggctgatcaaaccggggacattaagacggatgacaaaacgtacagcatgtttgccgatccggtaaaaacggacgataacgcgattcattccgtgcctaactacggtaccggactgacgccttatattctctctatgggcttgtatgtcggcggattgatgctgacggtcgtattccctctgagtgaagcttcagggcgtccgagaaacggttttgaatggttcctaagcaaattcagcgtcattctgctcgtcggactgattcaatccgtaatagtcgccacggttctgttaaaaggaatcgggcttgatgtggaaagcacttggagattctatctctttacgatgattaccagcatcgcgttcctgtcgatgattcaattattggcgacaacgatgggaaatccgggacgctttatcgctgtcatcattctagtgctccagctcggggcaagcggaggaaccttcccgcttgaactcttgccgggattctatcaagtgattcacggggcactgccgatgacttacagcatcaacgggttccgtgccgtcatttcaaatggcgattacggctatatgtggcagcaggcatccattctgttgggcatcgccgttgtcatgatcgcgctgaccatcgtgtattttacggtgcaaagcaaaaaagaacacaaaacggaagaagaaataacagcataagaaaaagaggcgctgagcagatggtcagggcctctttttttgatttcgattaaaatccccatctcaccaacagtccggtatacgtcaatccgccgccgaacccgaacaataccagcgtctggccttccgacagtttttttgctttcacagcttcatccaaagcgagaataatagaaaccgatgaagtgttgccgtaatattcaacgcttgtcaatgtccgttcaagcgggaagggcagtttttcacagatggattcgatcatccgcatgttggcgctgtgaggaacgaaccaatccagatcgtcttttgaaaagccggctttttctaaaagggcattgcattcctcaggcacggttctggccgcccatttatatacttcgcgcccgttttgcaccatgtttcctccgcctttaagcggctcgccgtttaattctgcgctcagtcccgtgcgatacagcacgtccgcgctgcctcccgctgttccttgcacggctgccaaaaagcccggcgctgattcatcgcgttccaccaatagggcgccagcagcgtctccaaaaagaacacaggtcgtccggtcagtataatccgttacctttgataatgtttcaccggcaatgacaatcactttttgatgggaaccggcggtaattaatgcgtctgcgagctgaaggccgtaagtgagtccggcgcatgtggcgttaatatcaagcgcccccgtttgcggccagccgaagtaagcctgcacgcgtgccgcggtgcttggaaacgcatagtccgccgtcgttgtggcgacaaggatcatatcgacatcatcaagagttccgctgtatcgttctgcaagatttttcaccgcttccacacacaaatccgatgtgaattcatgttcgccggcaatgcgtctttccttcataccggtgcgctggacgatccattcatcagatgtatcgacgatgcgctccaaatccgcgtttgttaatcggcgtgccggagcatatgtaccgattgctgtaattttagattttgacatgaaaaaatcactcctttatatcagattataacacctgatattattacttggtactaattttaataaaaaaacccaagcagcatccgctgtttggggagcatgagaatctatttgtaaaacgggcttgtgtgaacgattaccaatgacggcagcggcagcatgaatgatgatgcttctttttatctttcttctttttacaagggtcttcttttttctttttacagtgatctttttcttttttacagccccagaaggctgcaccagaccaattatcctcaaaccaatcctcaaaccaatcattatgaaatcttttccgcttgtgcggtttacggctgatcatacatttccctcctatgctcatgctcccttcattctatgaaaaaagagaaggaaaagattggacgggttatggatcaaaagagtatattttaagaagaataaaattgataggaggaatgacctgtggaaaatatgaaacatacgatggaactgattaaagaattggtgtcgattccgagtccgacgggcaatacatacgaggttatcgcctatacagaaagtcttttaaaagaatggggcgtctcctcttacagaaaccgcaaaggcggtctttttgtcacaattcccggccgtgatgacaagaaacacagattgctgacggcgcatgtcgatacgctcggcgcgatggtaaaggagataaaggcggacggccggctgaagattgatttgatcggcggcttccgatataactcgattgaaggggaatattgcgagatccaaacttcttccggcaaaacctatacaggcaccatcttaatgcatcagacttcagtgcacgtctacaaggacgccggcaaggcagagcggaatcaggagaatatggaagtccgccttgatgagcctgtccggacgaaggaagagacgtccgatctcggcatcagggtcggcgatttcatctcatttgacccgcgcgtgcagattacgccgagcggctttattaagtcccggcatcttgatgacaaagcgagcgtggctctgctcctgaatttaatccgccgtatcacggaagagaaaatcgaacttccgtatacgacgcattttctgatttctaataatgaagaaatcggctacggcggcaattccaacattcctcctgaaaccgtcgaatacttggctgttgatatgggagcgatcggcgacggccagtctacggatgaatatactgtctccatttgcgtgaaggatgcgagcggcccgtaccattatcagctcagaaaacatctggccgggcttgcggagcgctatggcattgattatcagcttgatatttatccgtattacggttctgatgcctcagcagccatccgttcgggccatgacatcgtccacgggctgatcggcccgggaattgacgcttcacacgcttttgaacgcacgcatgaattatcgcttcttaatacggcaaagcttttgcatcggtacgttctatcgccgatggcataaaaaaacctgcgcggaaatcattccgtgcagggtttttttaacctgagatggttgtgttttgttctgttttggcgaggctcatgaccttcgcgcctttaacgggatcatactggccttcccattttgacatcacaacggatgccagcgcgtttccggtcagattgacgaccgtacgggccatgtccataatccggtcaacaccggcgatgaatgcaaggccttctgcaggaacgccgattgtgccgagtgtcgcaagcaggacgacgaaagaagtcccgggcacggcagccattcctttggaagtgaccatcaagacaagcacaagggtaatctgctgccaaatggtcaagtcaatgtggtatacctgagcgaggaataaagcggcgattgattggtacagcacagatccgtctaagttaaaggtatatccgatcggcacaacaaaggaaacaatacctttcggacagccgattttctccatcttctccatgatgcgggggagtacggtttcggagcttgacgtactgaacgccaataaaatttcatccttcatataggcgaggaatttgaaaatgtttaaaccggcaagctttccgacgattccgaatacaacaatgagaaagaaagccaaagctacatatactaaaccgaccagtttaccgagtgaaagcagggaactgagcccaaatttggaaacggtaacaccaatcaacgcaaaaacaccaaacggcgcaactttcatgaccaggttcacaacatggaacatcgcatgagaaacaccttcaaagaaggccaagacaggctttcctttttcaccgattgccgagatgccgagtgcaaacagcacggtaaagcagatgatggcaagcagatctccttcggccaatgattggaagaagtttgtcggtacgatatgcaggaatgtgtccgcaacggatttgccgctttgttctttttctgtttcaacatattgactgatatctgtcttttgagcttcatgtatattaacgcctgcccccggctgaaacagattcgccaaagccagcccgagaataatggcaaaagtagtaatgatctcaaaatacaaaatcgttctgaagcctaattttccgacttgttttccgcttcccgcgccggcaacgccgatgattaagctggagacgacaattggaatcactatcattttgattaagcgtaaaaacaaatcgccgataggctgtaaatatgttggaatggcgggattgccgtaccagatgacaccgactacaacccctagtatgagtccgacgaaaatttgcgtcgctagtccaaagcgtaattttttcatagattacctcccgaagaaaaaagtgcaataagtatctaaaaagatagctattagaacaaattataatagaaaagaaaacaatccgtctatagaaaaatatagattgaaaatactgaatattttaaaacgtacagataattgctaataatggtgaataacgccctattcagaaagtatgatgacggacgaaaaaaacgggcgccgcacaacttagaattgtgcggcgccctattgtcacatatccttaattttcaagcagtcattacacaaattaatgtgacactcatactgctcaacaatctcatttccgcattcttcgcatttcttaccgggtaaatttctgaaaaaatccgacatcttttccaacatacccatccctctttcattgttttgtctttacattgtattataacagtttgagaaaatcaacggctgttttggcacaatgtttaaaacatgcaatttgtacgaaaaataggtatattggaggaaaggaactttttatcataaacattcggaggattatatgaaagttacagttattggatgctgcggcgggtttccggccgcaaacgaagcaacttcaggctatctgtttcagtccggcggctattctctgctcgtcgattgcggaagcgccgtattatcaaagctgtttgcctatgttccggcagaagagcttgatgccgtcattttgtcccattatcatcatgatcacatcgctgatatcgggccgcttcaatttgccaaacaggtcggctcctttctcggaaaagggacgcatgcactgccgatttacgggcatgatgctgatatagaacagtttgagcgtcttacatataaatcgcatacaaaaggagcggcctatcagccggaccgcccgctttctgccgggccgttcaccattacctttctgaaaacggtgcatccggtcacttgttatgcgatgcggattactgacggttcagcttctgttgtgtatacggctgattcaagctaccaggacgcgtttatcccgtttgcggaaaatgccgatctgctgatctgtgagtgcaatttttacgcagaccaggacggcacgtcagccggccatatgaacagtttggaagccggacgtatcgcgaaggaggccggagcgggggagctgattctcacgcatctgcctcatttcggcgagcaccggaagctgaaagaagaagcggaatccgtgttcgggggcgaagtgacaatcgccgcttccggattgaagtgggagaaataaaggaggagcaccatgttatttatcgacaatcaaaacataaccgacccgaggatcaacctcgcgatcgaggaatattgcgtgaagcatctcgaccctgaacagacatacctgctgttttatgtcaatcagccctcgattatcatcgggaagaaccaaaacacaatagaagaaatcaatacgaaatacgtagaagataacggaatcatcgtcgtccgcaggctgtcagggggcggtgcggtttaccatgacctcgggaatctgaatttcagttttatcaccaaggatgacggcgacagctttcacaattttaaaaaattcaccgaacccgttattcaggcgctgcgccagctcggtgtggaagctgaattaagcggccgaaacgacatcgtcgcggacggcagaaaaatttccggcaacgctcaattttcgacgaaagggcgtattttcagccacggaacattaatgctggattccgccattgatcatgtcgtgtcagccttgaaagtgaaaaaagacaaaatcgaatcaaaaggcattaagtcaatcagaagccgtgtcgccaacatcagcgagtttcttgatgacaaaatgacggcggacgaattcaaaaagcacctgcttcaccatatttttaatacaaatgatctttccgaagtgccggaatataaactgaccgatgaagactggaaagcgatccggaagatttccgaagagcgctatcaaaactgggactggaatttcggaaggtcgcccgcatttaatcttcagcattcgaaacgttatccggtcggatcgattgatctgtgtcttgaagtgaaaaaaggaatcattcaggactgcaaaattttcggtgatttcttcggtgcgaaagatgtgagtgaagtcgaacaggcactgaccggaaaacagtatgaccgaaccgctatcagggaggcgctggccggaatcgatctgaaacagtatttcggcaaaatagagctggaagatttcctcgagctgatttattagaacatttgccgaacgcatgatttgaatcagcgcccgtttttgtgaaatgatagaaccataatgaatagggagggatcatgatgaaagtatttctcatcggagcaaacggacagatcggacagcggcttaccgggctgtttcaaaaagacggcacgcatacgctgcgggcgatggtccggaaacaagagcagaaagaagcgcttcaagccgcgggaacagaagccgttcttgcagatttggaaggaagcccggaagacatcgcgaaagccgccgaaggctgtgacgcgattgtgtttaccgccggatcaggaggaagcaccggctacgataagacgcttttgattgatcttgacggagcggcgaaagcgatagaagcggcaaagaaagccggcatcaagcggttcattatggtaagcgcccttcaggctcataaccgcggcaattggaatgaagcgctgaagccgtattacgccgcaaagcattatgcggataaaattcttgaagcgagtggtctgacgtatacgattatccggccgggcgggttattaaatgatcccggcacgggaaatatcaaagccgcggccgatttagaaagaggctccatttcaagagacgatgtcgccaagaccgttatcgcatcccttgatgaaccgaatacgtatgaaaaagcattcgatctgacggcgggcggcacgccggtcagtgaagcgctgaaacaattatagtttccggttttacggcactcggggctttttgcccttgagtgtttttctatatttttctataataaaagtgaacgtttattccggataaatgaatgactattcattcattacatttttaaaggggtgggaaaatgaatctggtttccaaattggaagaaacggcatcgcagaaaccggaaaaaccagcttgtctgtttcaagatcagtacatgacgtatgaggagctggcaggtaaaatcaaagcatttgcaaacggcttggaggacaggggactgaaaaaaggggatcatctcgcgcttctgctcggaaatacgcctgactttgttattgcgtttttcggcgcgttaaaagcgggaattgtcgtcatacctgttaatccggcatatacaccttcagaaatcgcatacatgctgaaaaacggcgatgtcaaagcgatcgccggcatcgacctattaattcccgtatttgaaagcctgcacggctcgctgccgctgctggagcatatcattatcagccagacagcagagaacgctccatcgacagaagaccctcaattgcgcttaaaaatgacaacgtttacaaaaatgcttcgcccggcggagcgcagcagaacttatccgacattgtcaaaagatgatactgccgtcattttatacacctcagggacgaccggaaaaccgaaaggcgccatgctcacccatcagaatcttttctccaatgcaaatgatgtcgccggatacttaggaatgaatgagaaagacaaaattgtggcggcattgccgatgtttcacgttttttgtttaaccgtttgtatgaatgcgcctctgatgagcggagcgtgtgtcttaatcgagccgcaattcagcccggcttctgtatttaaactgattaaaagccgtcaggcaaccatttttgccggcgttccgacgatgtataactatctgtatcaatatgaacacggcaaggcggaggattttgcgtccgtcagactgtgcatttcaggcggcgcctccatgccggtcgctctgttgcagacgtttgaacaaacctttgacgtcaccattctggagggatacggactttctgaagcgtctccggttacttgttttaatccgtttgaccgggggagaaagccgggctcgatcgggacgaatattttacatgtcgaaaataaagtcgtcgatacactcggacgcgaattgcccgaccatcaagtgggagaattgatcgtgaaagggccgaatgtgatgaaaggctattacaagatgcccgaggagacggagcacgcgctgaaagacggctggctgtacacgggtgatttggcgaaacgcgatgaagacggttatttttatatcgtcgacagaaaaaaagatatgattctcgtcggcggatacaacgtctatccgcgcgaagtagaagaagtgctctacagccatgagggcattaaagaagccgtggtcatcggcgttcctgacgccaaaacgggggaagcggtgcatgcttatatagtgcctggggacggtgagctgacagagcaggcggtttttgattactgtgaaacacatttggcaaaatataaacggccggcggaagtggtttttcttgatgagattccgaagaacgcgaccgggaagctgctgagacgggcggtccgggacatgcttccgaaatgacggacgaaaagcgaagccgggggcttcgcttttacatgctgatccggtcagctctgcgattcttccttaatgatgctttgcacaagcttcgtatcatgccgggtcagtttgtaatacgtgtttttatacttgtacatcatataattgccgccttcgagccacatgctgaatgaatcaaaacggtcttcatgatatttgaccgttccgtcgtaatcgggagacacgcttttggtcagtttgacttgttttccttggttcaagatatcgagcatatcttttacattctgcctgtctttaattttgatttctttttttccgtgctcagacagaataatcagatctgcgttgcttgatggaaacacatcgccggtccggctgtatacatagaagaaagcaataaccaaaagggcgattactacaataaacgcgattatttttttcatattcatcactccgtcttttagtctttcccgcttcctgttgttccattcttttctgttgtgaaaagattaacatccgtttcggaggcttggttctatttatttgcatttatgcttacaataggagtaagtcataaggctaaggagggagacttccatgcgcaaatggatagcggcagcgggaattgcctatgtgctgtacggcctttttttctattggtatttctttatgacaggagactccgccgtcccggaggccgtaaagggaacgaaagccgatccgtcctcgtttatggacccgggccgcctggcagccgctgaaaacttttcaaatgtaaaggattttttatttttcatcggagcgccgttagattggtttttattttttctgctgctcattacggggcttgccaaaaaaataaagcattggctggaagcagcggtgcgttttcgggtgctgcaaatcgtaagcttcgtatttgtgatttcactcatcgttacggcggcttcgcttccgcttgagtggatcggatatcgggtttcgcttgcgtatcatatttcgacgcagacagcagcaagctggataagagaccatgtcattgatttctggatcagctttccgctgtttgccgtgtgtgtgcttgtgttttactggctgatcacaaagcatacaaaaaaatggtggttttacgcttggtgtcttactgtgccgtttaccctgtttttgtttttcctgcagccggtcgtgattgatcctttatacaatgatttctatccgctgaaagacaaggagctggaaagcaaaattttgtcgcttgccgacaaggccgacattccggccagccatgtttatgaagtaaatatgtcggagaaaacgaatgcgctgaatgcgtatgtgacggggatcggttcgaataagcgaatcgttttgtgggatacgacgcttaacaaactgaaggatcgggaaattttgttcattatggggcatgagatggggcactatgtgatgaagcacgtgtacatcggactggccgggtatctgctgctgtcattagccgggttctatatcattgacaagctttataagcggctgtccaaattcttcggccgaatgctccatataaaggggcctgaagatctggccgccctcccgctgttattgctcctcatatccgttctcagttttgcttctgatccgattacgaatgccgtctccaggtatcaggaaaacgccgccgaccgttacggcatcgagctgaccggaaaccgggaagcggcgattgagacgtttcaggacttggccgatacgggactgagccgggtcaacccgccgtttctcgtcaaaatcttcagagggagccacccgtcgatcatggagcggattgaacatgcggaggaagaaaaataataaaaaaaccggcggggccatggccgacgccggttttttatgttttactgagctgccgcctgtacgttgatcagcccttttccgtagtagaaagcatcaccaagttttgtagtggtgttttctaaactgctgcggacttgagtgtttgtccagttcgggtgcttagaaagaatcaaagcagccgctccggcaacgtgcggagatgccattgacgtaccattgtacgcgccgtatttgtttccaggaagcgtgctttggatagagacgcctggtgccatgacatcaagctcagaacctacgcttgagaaagatgctcgttggttgctgctgttaactgcccctaccgcaatgacagaagggtatttaccagggtagcccactgtgcttgagccgccggaagtgccttcgttaccggctgccgctacgactacgatgccggaagcaacggctttgtcaactgccgcttttaacgctgcagaaccagaaggtccgccgaggctcatgttaataacgtccatattgtttgcgatcgcccactcaattccgttaatgatccagctgtactggccggaaccgtcagcgccgagaacttttacagcgtaaagagatgcgcttggcgcaacgcctaatacaccgactgagttattaagagccgcaactgtaccggcaacgtgagttccgtgagagttgttgtcttggaaaggatttgtttcagaaggaaccatgctggctccgcctgctacctttaaatcaggatgagaagaatcgataccgctgtcgataaccgctactttaacatttgatccggtgaagccttgagagtgcagagcaggggctttaatctgtgatacgccgtaaggcacggactgcgcgtacgcctgtgcaacgtgatcttcttcaacgtaagcgacgctagggtcttttttcagctcttttacagctttttcatttaatgtagctgaagctgcgtctacatatttgaattgcttttgcactttcccgcctttttcagaaatgacatcttttttcttagcggcgctcatcgtgctcattgtctgtttaaatccgacaatgtatttcttttccccgtttgatttccctgccgcctgggcaggagacgtgctgccgaacgccatcgtaaagattaacgctaaagcaaacagcaaactgatccatacctttttgcctctcactctttatcctctcctttttttcatttgcagaacaaccaatagacagattattctgtggattaattgtatagcatggaataatattttagtagacccaattttttcagtttgttttatttctatttaggtatatcatctctctttcgtttaataggaacccgaaatatttaaattttaatggaaaaaaccgatggaaggacatgagtatttgtacacagccgcgatcgctctcttgtttgctgggtcgaacggtttgattccatttttggaagctgcggcaaaaacaggataaatgtcaccttttgttgaatgcagaagtctgatggaaacgaaagcggaatgaaataaagcggccggcatgaatcagtcttcggctttcttgacggagaaaagctgtgaaaccattttataaaaataatgataatgaatatcattgatacttatattgtcaatgatataattgcggaaaaatgaaagaggaggaacagatgaaaccaattttcagtatgctgatgatcttatccgttctcttcataacggcatgctcagaacaggaacatgaaaccgccgtcaggcacgatctggggacggcgcatgtggctgcgcacccgcatcgccgtattgaatgagggctttattgataccctccatgatctcggtataaagccggcggccgcggcggatgaccgggcagagcgaaacgacggcagtccgtccgtcgggctcccgtcacatcccgatttgaaaaagatcacttcgttaaagcccgatctcatcattgcagactcaagccttcacaaggggatataccatgagctgacaaagatcgctccgacaatcgctttacaaaatgaagctgcggattatcaggatgcggttgacgctgcccttactattgaaaaggcggtcggtaaagatggcatcatagagaaacaattgtcggctcaggaagaaaagctgaatgacatcaaaagaaagctggatgcagaaggcggcacgattttattaattgacgctgcaaatgacagcatttccgtaaaggatgaccggtttttcacgtcccggcttttgacgctcgcagggtttacatatgcggtccagacggattccggcgggaaatcagactctttcaaaatgacgcccgggcagcttttgcatatcgatcctgattacatcgtactgttggacggtgagaaagaactcgaaaaaaatcacctctggaaacagctgacagccgtaaaaaacggacacgtttaccgcgcggacagggcggtatggacggagcgccggagcattgacggtgcggacgccatattacatgatcttcagaaaaaaatgctcgccaaaaaggcccaaaactgaattcgggcctttttgttatgattctgataggtggctgcttatattgtaatctttgacgcgccacttattttcaattcgttcgatattgctcaggcacgcattgacaagctttgcgttttgtatgtcggtatcaccgtcagaaatggcggacaagagggcgtgaatggctgcgccgtgagcgacgatcagtactttttgctcaggaaaccgctcctgaactttcactaaaccggcaagcattctgtctgtcagctcttctgctgtctccatattcgggtagtttttatccgggtagcgcttcgaccgttccggtaaggacattccttccgcatcaccgtagctccgttctctgaaatcttccatgacaacaatgggaagattcaaaaacccgttaataatgtcagctgtttttctggcccgtttcatcgggcttgagacgatgacatcccattcggacccctttaagtactctcctgtttctttcgcctgacgctctcccgtcgcatttaacggaatatccgatttgccttggagcttcttttgggcattccaatcagtctctccatgtcttactaaacaaacggcagtcataaagtctccactccgatcattttttatcgatatcatctattatactgccgttacgttaacacttcaaagagaagcgccagtccgactccgcctccgctgccgatcgcagctgctgcgtagcgggaatccgggcgtctttttgcttcataaaaaagccgggtgacaagcgccgccccggaagccccgtacggatgcccgacggccagagcgccgccccggacatttattttagaatacggcacttgaagctgctgtgaaaaaacgcatattttgacggcatacgcctcgttgatttcgtatatatcaatatcatccggtgacaggttccgttccttcaaaagctttttgacggcataaaccggggctgctgacggataatgcggatggacgccgcttaccgcgcttccgataaaacgcaatcttggctttaaaccgagagaccgcgctttttgttcttccatcacacaaactgccgccgccccatcagaaattccgcagctgttggcggcggtgacagagcctccggactgaaagacgggtttggcacgggagatgagaggctccatgttccgctttttcagcatgttttcgtcagcggcgaatccgtgacagggaagaatttcccggcggtacaagccgtcttcgtgcgctttgacgctccgttcatagctgagaagggcatattcgtcctgcatctttctcgttacgccgtaagcctgtgccgtatactcggccgctatgcccatatcaggatcgccgatgtgttcaggagaaaagcgcgcccgggatgagaaaggggaacggctgctgctctccgctcctcccgcgatgtacatgctccccgcgccggctttaacaaagtggcacgcgaccctcacggcgtccagtccggagccgcactgtctgtcgatggtcgtaccggacacgctcaaaggaagtccggcggccaaggctgacagccgggcgagattcccgccgcggcccgtcgcgtttccgatcaggacttcatcaatgtcttcgggcatgtttcggctcaaatggcgaatcagcggagctgccaaatcttctgggagacagtcttttaacaggccgttttcccgggcgaaaatcgtccgtttcgcatccgtaattacagcttccattccatcatgtcctttgcctgcttttgtacggcggcacgggcgatctttccgccggctgtttccggtatttctgaaaacagccactttttcgggattttatatgccgccagctgctcgcggcactgtttcttcagttcctttacatttgcatgtccgtcgatcaccgcaacggcgatgctgccccaataatcatcaggaacgccgatgacggccgcttttctgacgcccggacagcggttgagcacacgttctatctcttcagggaatacattcaggccgcctgatacgatcatcccgttttcacgtccttcgatataaagatagccttcacgatcgatatatcccatgtcatcaaccgtcatccagccggaatcatcaggttttgcgccgttgatgtatccggaaaatttcatcgggctgttcacaaaaatcttccccgtttcgcccggcatgcagcgttctcctccggggcggcggatttcgattgtaacattttcaaacgggcggcccgccgcgtcaggctttcgggcgctgtcttcaggcgataagaacgccacgaaactcagctcggacgttccgtaaaaatcgtacaaccgcaaatggggatagcgctctgacagcgcttgttttgacgaagcgggccagtctgcaccggaagaaatcaccttgagcggtgtatccggaaacgcctccagtgagagcagggcatccgtcattgtcggcacggtatatagaacgtcagcttgtctgagccggtctttcattccggccggattgaattttctttgaaggatgacggttccgccgataaacaaagtgctgacggcgccgtataaaaagtgtgacgagcgaagcgtgcccggtaccagcactttgtcatcaggggaaatgccgaattcacgtttcgtacaagaaaagctctccagccacgaacggtgagagcgggtgaaggctttcggcttaccggtcgatcccgaggtgaatccggtataaaagggcaggccggcgttttcgataaaagcgccttccgttttttccgcctcgatcaaaggcctgcattcatcccacaggatgacaggcgttttgacgccgtccagtctgccgctcagccggcggtcacagatgacgaggtcggttttgctgatgtgcagctggtccgcgagttccgccgctgccgagcggggatctaacggaaccgccgtgcagccggcatgcgccgcccctgcgaaaagttgtaaaaatgggatgccgttcggcagtaatattgcaatgttttcgggcttatctgaaaggctgccaagccagtttgcggtttggtttaccagcctgttccaagtttgatagttgatctgttctgtttctgtctgaattgcgatctgttccggcgcttgtccggctgtatctgaatatgatgatgtaatcatgatgactaaaatcagcttcctttcgtcggcaaaagccggcttgcttgaagagtttttctgattcttacggctgcgaatgaggctgcggccgctttaagcagatctccgggcacatagatgaggctgagctttacggcagtcaagatatcaatgtgcatcataaaagcctgaacgggaatgccgatgacatataaaaacagcacaccgaacaagaactgtctgataaacaaatgggggacagcagctgagcgaaggccttggatgctgaggctcagaagtaatgccgccagcggatatgcgatgagatatccggcgctcggcccgaaaaaaaccccgaacccgcctctgccgcctgaaaggagaggcgctccgcatgccacaatcagcaaaaaaagcaattggcttaaaaacgccgctttcggttttaggatgcttcccgataagagcacaccgatcgtctggagcgtaatcggaaccggcgtaaaagataagaaaagcggcgggagcagccccaaaagccccataatagcggtaaacacggcaatatgcatcatttctgtcaatttcattatgtattcctccagcttatcaaaatatgtttatacaataaagcgagtctttatatatgtcaactctattatattttaagttaacattaaaaagaccggccctttatgaaaaaggccggtcggtttatctttattcttctgtaaggataacaagtgaatcaacggatgatgcaacgtgggaaacggcgcggctgacttcttgaaggccgccgagaaaggcctgcaaatcaacgtcgattttgcctgtctggtctttgctcgttttcatgctttggacgatgtcatcaaacagacggttgatctgcgtcattttttctttcgtttcacttacaagtccgttgacatctttaatatgtttggacacgatgttgatttgtgtattggtgttgttcacgagctctgatacggtggaaacggtttttttcgtatcctctgaaagctttcttacctccgtcgccacaacggcgaaccctttgccgtgctctccggctctcgcggattctattgaagcgttgagcgacaggagattcgtttgctcggcgatccccgtcacgatgccgaagattttttcgatctgctgggcgatgtcattcagcttgtccatttcttcttcaatctgcagaaggctggcgtcgattttattcatctgcttctgctggctttcaagctcttttttcccgccgattgatttttcttcgacatgtacggaagtgacggtgccggcttttgacgcctcggaaatgccctcggatttatcgaccagctcctgcacggctctgctcgtttctgaaaacaaatcagcgagtgatccggatgtttcctggattttttgatgaagacgggctttcttttcctcttgttcgtcacgctggcagttatattcgctctggaatgcttcaaggacgagctgctgttcaagattcaatattttcgtcgtcgctttgatcgcttttaaaagctcatgcaaatccggaattgctgcttcatatatgttcatcatcgacagaagcagatcctgaaacgctcccatataccatttcggttcaaggccgatccgcaagtggatggaagcgatgcgctgtcttttttcaatgaattcatcatcaatcgtgccggcgaacatctcatggatatgacgccgtaatgttttttttaggcgctcgaccgtgctgtggtcgttaatgatcgtcattaatgatttttcgtgatccagatttcggtaaaaggaatcgacgattgttgagatatgttctttaattaacggctgcagctcttcaagcacatgaagttcttcgtttccgagcctgaccattttcagctgtttttggacatctgcatattgatttgaaagcgcgatgcgtttttttccatcggcttctgaaaaataagctgtttcttttttgcggtcttttttaaataacaatataagttcccccagatattctctttttctttttatcggtatggaaggaacttgaatgaaggaatctgataaaaatattttaatgcggaaaaaaataaaaccattcgtacagaatggtttagtcaatcttggctgaggcgcttcagcggcttgatggcgggaccttcggcaaccccgccgtcaggtgtgaaccgggacccgtgacaaggacagtcccacgtccgttcgccgtcattccattcgacctcacagcccaaatgggtgcaagtcgtatcaacaagatgcagacagcctttttcatctttataggcgccggcccgtttgccgtttaccgttacgatttttccctccccgggccgaagagtctcaggtgaagcgtccggcctctcaagtttgcccgagataaggtgtttggccacgtcggcattataggaaatcagttttttcagtcccggatctgcgtggaagcgtgacggaataaacaggccggaaaacgggttctttttgttttgaatatgatcagccaaaagcttcgcggcgagcgctgagcttgtcatgccccattttttaaaaccggtcgccgccaaaatatgttcttcatcgcccgagatgggaccgatgaacggaattttgtcaatggtgacaaggtcttgtgcagaccaatgatatgggatgctttcaactccgattgtgtcttccgcaaattgtttcagtgcttcgtaatgctcggacatttcttttccttggcctgttttgtggctttcgccgccgacaagaaccagtttttcaccgttcaaatcggtgtatcgcagtgatctggacggcttgtctatgctgagatacatcccgtccggatacgcttgtttcggttttaccgcgagtacgtaggatctgctggcatacattctggcggcgtaaagcccgcctccgtcataaaaaggaaagtgggaagagcagacaatgtagctgcacttgatgccgtgtctgtttttcgtgaccacttccggctgcggttctttttttatgtcgatcgcagccgtctgttcaaaaatccgcgccccgtttttgacgatctctttgacgagcgccgcgccatataaaagcggatggaattgcgcctgattcttcatggcgaggccgagcctgcaatcaacggggacgggaagttctttcacaagctcgtgttcaataccgagcttggtataagcttcctgctcactgcggatttttttggcgcctgattctgtattggtgtaaagatatgcgtcttgttcaatcagtctgcagtcaatcgaaaggtccttgatgatctgcttcatgtcttccatggcgcggagatgggcttcgaaatacagccttgcgctggtctgtccgatctgctgaataagatcggcatagatgaaatcatgctgggcggtgatttttgcggtcgtgcccgcggtcgtcccgtttaaaatccggtctgcttcaatgacagcgacacggaaacctcttttcgtcagttcgtatgccgttgtcaggcccgtaattcctccgccgataaccgcaacgtcacattccgtatcttcagtgagggcgggaaaggaaggaatgtcagctgttgctttccaataggaagccggttcctcgtttgaaaaagtagtcaattcagatttacctcctctgttgtatattcttaatttttccaataagactctgttcatacatgaaattcgtataagttgctcaaattactcataatatagtaattaatgtaaaggagtgatcaaaatggctaatcagaagaagaaaaccttgccgccgcagcatcaaaaccggcagccgggctttgaatatgtaatggacccgcgccccgtttttgacaaaccgaaagcggcgaaaaaacttgaagggaaaacggcgatcatcacgggcggagacagcgggatcggccgcgccgtatccgttttattcgcgaaggaaggcgctaatgtggtcatcgtttactttgatgagcatcaggatgccgaagagacgaagcaatatgtagaaaaagagggggcgaagtgtctgctgatcgcaggggatgtcggagacgaagccttctgcaacgatgtcatccgccaggcgggccaagcctttccttccattgacatcctggtcaacaacgcgggtgagcagcacgtgcagccggggattgagaaaatcacgagccaccagctcatcagaacgtttcagacgaatattttttcaatgttttacttaacgaaagccgcgctccctcacctgaaaaaaggaagttcaatcattaatacggcctccattaccgcctataaaggccacaaaacattgattgactattcagcgacaaaaggggcgatcgtcacgtttacaagatctctttcccaatctcttgtcactcagggcatcagggtaaacgcagtggcgccggggccgatctggacgccgctgatcccggcgagcttctcggcgaaggaagtggaagtcttcggctcagacgtgccgatgcagcgcccgggagagcctgttgaagtggcgccgagctatttgtacctagcaagcgatgattcttcatatgtcacgggccagacgattcatgtgaacggcggcaccatcgtaaacggataatgtaaaaaaagccaatccatatggattggcttattcactctgtttgagtgcggcatattcttttgaaagcgtgaggaacgcttctttatttttatcatcaagcgccttattaatctgcattgtcagcatggcgatccggcgtttatacaaggattcatcaagcaccatttgaatgtaaatatcggccattgtcacatcgaattcgtttgctttttgcgtgttgcgggacttcatgagctcagtgtacgactttttctctttcataaagaatccccccaatgccttttttatagtatatggataacggccggaaaaatcaattaatttttataatctttagacaactaatacttggaaatatatcgacatatcctgcaaattgacgaaaaaacgaaaatgatcattgtataatgaggtgaaatgaaaaagaaaaataatatttaaatagtaatttaagactaaattacagctttaaaaggtgatttttagctatattcaaaaaaaacctgtcgttttccaatgacagatgatagattattagtataaattttcaagaaaaggattggaggctgcacatcatgtgccagaaaacacacgcacccttagaaagctacgaagtaaatcgttcaaccatcgctgttttgcctgaggaaatagacggtaaaatggggtcgaaggtcattgaaaaagactgcattctgtatgtcagcatgaagccgattcacatcatcgacagaagctgccgctactttggctccagctatgccgggagaaaagcaggaacatatgaagcgattaaaatttctcacaagccgccgattatggtggacccttcaaatcacatctttttattccctacactttcttctgcaaggcctcaatgcggctggatatctcatgtgcacgttaaagattttcaaccgacggcatttgatgacacagcggtcacgttctcaaacggcaaaacgatggaactggaagtatcctatcattcttttgaaaatcaggtttacagaaccgcctatctcagaaccacttttcaggacaggatgggcagtcatatcccgaagcggcaggaattcatgctgtatccgaaagaagagcggacaagaatgatctacgactttattttgcgggagctgggggagagatattagagagagctgtgatgtgaagggacgggtcctctccttttggggagggcttttttcgatttacatgccggtatagagttgtatcgtgtccgtctgttggctatgatgatgtaaagagtaatgatatttcattttaggagagatgggcatggatgtgttcgcaaaatatgtatcaggaatcgataacccggatcaccgtctcaaggcagaggaaattttgtcgtggacggctggccaatttccgaacttagaagcgcagatcaagtggaacaaaccgacatttaccgatcacggcacctatatcattatgtttgccgcggcaaaaaatcatttgagcattttacctgaaaaagagacgatggagcattttgccgatgacatcgctcaagccgggtacagcgcttcttcgcgcctcttcagaattcgatggactgatccggtgcactatgatctgctaaagaagatcatcgaatttaacatcaaggaaaaagctgaaaatccggggttttggcgctagcggacgtgatgttgaaggaggaagacatggacgttttcaaagactatttatcaagtatcgacagccctgatcatcgtctgcgaatggaggaaatcctgtcgtggacggctgaccgatttccgaacttagaagcgcagatcaagtggaacacgccgatgtttacggatcacggcacctttattatcggctttgcggcagcaaagcatcatgtaagtgtttcccccgaagaagcgggaattgcgcattttgccgacgacattgcccgtgccggctacagcgctacttcccgtttgttcagaattcaatggactgaaccagtgcattatgatctgcttgaacgcatgattcaattcaatattcaggataaggcggactgctcagcattttggcggaaataatgaaagaaatgttaaaaaaacaaccctgaggagggctgtttttttattggaaacacatgatcagcccattttaatcaagaagcaatggatgacgtactataaaaaataaggagtacgaagcagtgaatgaattttataaggcgttaacacatgtaaataaaattttttatgaaccaaatcacttaacgatacatgatattcaagaagaagctcaaaattcagagtatggggccggtatgtttcaactgcattcaaaatcagttcgattcagagtcgcaaaaataacgcctaacaagataggacagtttgttgctttttgggaaaaagatggagatggtaaaaaccaagccttttcatatgaaaaagctgctgatttattggttatcaatacttttgccggtaatcatcattttggacaatttgtttttccaaaagaagttcttgtaaagcaaaatatccttaaaacagccgctgcaaaaggaaaaatggcaattagagtttaccctaaatgggaaaatcccactagcaaacaagctatcaaaacacaaaaatggcagttggcatattttgttgaggcgaacgatgcagatcgttttccagcacaagacctgttaaagctatattctaactaaaattggacagccctgagccggctgacagtatgtgaagttaaccggtgcgtgagttggagaataacggggaacctcaacaaatgaggttcctctaattgttatatagaaatcgacattttgaatgtaacagagtttgtttattaaacgtaatccaaaaaataagggatttgcgtatccggcagaccctcacgaaacgcacgatgtcagaaatcgtgcgttcaacattctttatttgacgacagacatgctgacgctgctgcctgacactgtcaatttggcaaaatcctgtgtatcaatcacaggggtgactgctttattgtcgatcgagatgttcgtaaaggctgttgagaagtttgatttgatgtaagggcgctgatcctctgatgtgaccgcgacggtggcgagcgctttccattttgagacagagcctacatttgtttgggcgagttctgagatgatgcggccggtgtatccgtcattattcgtgccccaatatgtggcgcgggtattgccgttcagatttttgtaaatggtcagctgtacggtgctgccgggccggaagcctttcgtataggtgaattggctttctccttccagataccggacctggccttgcccctttgaaccgactttcatgatcggtttccatacatgataggtgtcactgtactgaagcccgatatcagcctctgtgcctccggtaaatcctgagtaaatataggctgtcccatttgacacctgaatcgagcttggaagctgaattttcgtgacgagaactgagcccgtgctgttcaggtaggcccttccgccgattcctttgctgagctgggacgccgcttccgccgttttgggactgatcacccccggaatatccgccgtacatgcgccgaatagaacggctgtagtgagcacacccgcaagaagcccttttttcatcatcatttctcctcctatcatcatagtcagatagcgctatcaattcatattataaaaggttttgggaaaaattccataaaagatatacgggcggacgtaaattaaaactattttcctatttatcttgtaaatggagattatttgaactatgatatgttcagcaatacagcatgattcaggaaaggggataggatagaaatgaaaaagacggcagctgtgcttttgtctttcggtctggtgttcggttgttcatacggagcggggcagacggcagaagcgaaaacaaaggtaaaaacgtatcaaaactgcaaggcgctgaataaggtgtataagggcggtgtggccaaatcgtcgaaagtgaaaaacaagggcggcagaacaaagtacaagccgtatgtatcaaaagcgctttacaatgcaaataaaagacttgaccgagataaagactatattgcatgtgagaaataaaaaaacaagcctctttaaagaggcttgtttttttaaatggattcggcggtgacggcggttccgtatccgattaattcggatgtgttctgtcctgcggtcagttcgaaccgcaggccgacgatggcgttcgctccgagctgctccgcctctctgatcaggcgctctttcaccgcttttttggagtcttccagcatttcagtatagcttttcaattcgccgccgacgacagattttaagcctgcaagcaagtctttgccgatgtgtctggactggacgatactgcttgtcaccaagcctttcacttccgtaatctgttttccggcgacggtttcggtcgttgtcatgatcatgcgtttttcccctttcgtgtatcttaccgctatcttaccatttaagccgccttttcggctgcgccgatttgtttttttctgactgcggcgctgactgcaaacatgacggaaatgttcagaaccagcgcgatgatgcctgtattcatatccttaacgatctgcggaagaaacggaaagagggttccgatggttgattcggtcagcgtaatgaaggacaccgttccgaccccggccgttatgccggcaaaagcgccgtggcttgtgatgaaacgccgcttcggcaggctgaataagagtgcggggaaaagctgggtgacaaggctgtagcccattaaaagcaaggtgacgatggtatttccgcctttcagcgtaaaatatacggatatcagcgcgatgacgggtacggcgtattttgcgagccgtgagactttttcgtcagtcgtgccgggcagaatggctttgtacacatttttggcgaacagcgtgcttgaggccattaatatcattgaaccgggtacaagcgccgtcagaatgcccgccgatccgatcagtccgacaaaccagggatcaaaggttttcacagacagctttaataaggcgagatccgtgtccgccccttttaaaccgggcacctgcagaatcgccgcaaatccggtaaagatgacaaacagcaggacgagctgataaagaggcatgatgattgcgtttttccgaaacacccgcggatgctccgccgaataggaagcagcaaatgtatggggccacatataaaagccgagagcggtcagcaaaaccgttgagctgaaccaggaaacgctctgtccggtttccggcagcgtgagaaaaccgggttttgcggcgtcaatttgtttgaacatttccgtaaacccgccatagtaatgaatgggcaaataaatgcctaaatacaggacgatgcctaaaatcatgatatctttaacgacggatatccacgctgaaccgtggattcctgatatcatcacataaatcgtgatggagacagcgccgatccagacagcggctgagggcggaatctgtccgtatgacgttgctgaaacaattaatccgagccctttcagctgcaggacgagataggggatgagggatgcgatgccgacgagcgatacgagaatgccgaggagcgggctgttgtattttgaaataaaaaaatctgattgcgacatcagtttgtgttgtttggcgtaagtccacacggctggcagaagccaatatgacaaaatgtaggcaaggcagccgtacgcgataatataaaaggcggggcctccttttccgtaagcccatccgcttccgccgaggaatgtaaaggtcgtgtatatttctcccgccattaataaaaagacaaacatcgtgccgaagccgcgtccgcccaccgtccattgttcaaggtccatattttttccttttcgggcccggattccgagatatacacaaaacaggagcacggcggccattacgggaaatgctgcgttcattccgcctcacccgccttgttttctttgtccaatttgtaaacggcggccatcagaacggaagtcagcaccgcccagatgacgacatacgcaagaatgaaaggcattccgaaaacataaggcgtcacccggttggcaaatggaatgccgacgagaattccgaaaaagggcagggcggcgagaacatgaatcagtttcataacattcctccttttcattgaaaacagcgtgtcccgattataaagaaaatcatgtcgaatgtatagtgtgaatagtctgaaatttatcgactgaaaaggaaaagcagtcccggctgctttttaaatggtcgcaagagacaggtaatattccaataaggcggttacctgttcccgtattctcgggttgaaataacggtgtttttcttcatagccgttaatggtgcatatataaagcgtaaatgcttcgtctctttccgcttcgtatagtttaattttacgctttcttaactcttttcgaacatcactcaaatccttttgtgctaattttaaagagcagccgataagctgtttatagggttgttttaatttgaacgggcacgaatcaagcgcttcgaggtcccggttcaggatggcagccgccatgggcagaaacagccctttttcgatgagatcgcgggtgccgctccggatgtcaggcataaatactccttctttcttaaaaaagagaacgtttgttcttattttatactcgcttacacgatatttcaaggcggaaaatctcgtaaacattttcgttttttggagataatgtgtagaataaggatagacaaactcgttaaggagtataaacgttggagcattttttatcatatttgactgaggaacagctgacggaatggttccaaagctatagagctttcggcccggcggctgcggctgcactgccttttattgaagcgtttcttccgtttttgccgcttgttgtatttgtggtggcgaatacgaatgcatttggtttgtgggaaggtttttttctgtcgtggctcgggtctgcggcaggatcgatactgatgttttatgccgtccgccgtttcggacagaaaagagctttcggtttcatccgcaggcatcagaccataaggcggatgatgctctgggttgagcggcacggtttcggtccgctgtttattttactttgcttcccctttacgccgtccgctgcggttcatatcgttgccggtctgtcacgggtgggggcgctgcagtttatatcagcagccgctatggggaaaatggtcatgatctttatgatcagctttatcgggtatgatcttcacgcactcatgacacagcctttcaggatggcgggcgccataacggtgatcggggtgctgtggtatgccggaaagcatatcgaacggcgtttacagacgagaatcagtcagcatgagaaagacggagggagacaggaatcttgaaaaaacgattttggtttatagccggcgtgcttatcgttgttttggccatacaattaaagaatgccatttttattgattataaagtcgaaggaatcagcatgaatccgacctttaaacaaggaaatgagctgatggtcaacaagttttcccatcgttacaaaacgatccgccgtttcgatattgtcctgtttaaaggcccgcaccgcaaagtgctgatcaaacgtgtcatcgggctccccggcgagtcaatcgcatacagggaggatcagctgtatgtgaatggaaaacgggtggcggaaccgtttttaaaaccgttaaagtcatcattgtccgccgggagccatgtgaccggtgattatacgctgaaggaaacgaccgggcgcaaaagcataccgaagggacaatactttgttattggcgacaaccgcatatacagcctcgacagccgtcatttcggtccgattaaggataaagacattgtcggagtcatcagtgaatcagacgccaagtaaacggcgtctttttttcggaaatgattgtaaaaaagcagagggaagactataatgaaaattgttacgcgcgaaacaaaaaggaggcgttttattttttggtgattttgttactcgtgtaacaaaaaatatgaaagagggctgatgagatgaaaacacaggctgccattatcgggggaggtccggtcgggcttatgcttgcatcagaactggcgctggccggagtgaaaacgactgttattgaacgattgaagaagacggtgccatattccaaagcgcttattatgcatccgcgaacacttgagctttttgccatgagaggcatattggaacgctttttggaaaaagggacgaaggtgtcttccggccatttttccatgctggatacacggctggatttttctcggctggatacgaagcagaattattcgttaatgctgcctcaggcagaaacggagcggattttggaggagtatgcatcaagtctcggcgcagacatcatccgcggggcggaagcgatggctgtcacccagacggatgacggagtggagacggtgttccgggacgaaagcggtatccgcactcttcacagcttatatgccgcgggtacagacggagcggggagcattgtcaggaaacaggcgggcatcgctttttcgggcactgatgccgacttaacaggaacgctctgtgatgccgctttgaaacatccgcccgaatcttcctttttttcaacgtgccgcctggagggatcggttgtgattgtccctcttacggacggacttttccgcgttctcatcgtttctccgcacgctccgcaaaagcggaaggaagagccggtcaccgaaaatgagctgaaagaagacctgcggcggatatgcggcactgatttcggattgggtgatccggtatggatgtcgcggttcggcaatgccgagcgtcaggccgaacaataccgatcaggccgggtttttgtggccggtgatgcggcgcacattcattttcccgcaggcggccaaggcctgaatacggggcttcaggatgccttcaacctcggctggaagctggcggcgcaaatgaaggggaaagcggcgccttatcttctggacagctatcatcaggaaaggcacagcacaggaaaagaagtattgcacaatataaaaacccagataaagctcatggattttaccgagtcggggatggcattaagagaaacgatgaccgctttgctggattttcaggagtccaaccgtttattggcgggaaaagtatccgcgcttgatctgcattatgaaccggatgcggagctgccgccgcatatcctgaacggaaaacgcctgccggatatcgaattgatccttcatgacgggcggccggcccggctgtatgattttcttcataagggcgcctttgtgcttttatcattaagagggagcattcatgccggtattgatacggacagcgtggcagctgtcagggcggagcttgctgaaacacgtgccgattgggatgacgtccacaccgttttaatccggccggacggccacgcggcatgggcagccggcggctcgggacgtgaagcggaagaagctgttctggccggtttggagagatggggattcatctgatacccttttatgcgcctgtgtgattgtttcttgtgtaacaaaacgttatagtaaaagaaacaatcaatacggaagggtgattcagcagttggacagaagacagccagaccatgcaaaacacatgattcttgaagggctgacagatatttttcacgagcaggagaggtgtcaggaggacatcagggcgtcgttggccggacggatggacgaactccgtgaagaaaacggaaaaaaattacagctgaccttgacggaaattcacattttgtcgtgtatcggagatcatgaaccgatcaatgtcacgtcaatagcggaaaaaatgaagacgacaaagccgaccgtgtcgagaagctgcgcgaagtttttggaagccggctttctgcgcaggacccggctgagcgacaataaaaaagaagtctatttccggctgactcctgccgggaaagagctgcattccctacatcatgaatatcatgaattgataaaaaagcggctcttggcgtttttagaccgctatacagatgaagaactgttatttgctgaacggctgttccgtgatctttcagcaaactggcggtctgtaaatggcggcggagagctgttcaaataaaaaacacgcatatgaatgcgtgtttttttattcggatcatgttcctctttctgcccggcctctttcgccgtgtgcccgtttcagctgagaaaggtggtgcagcagccgatagaagggcggaagcatggcgatgacgagaacgatccggatgacctgaaccgcgacgacgaaagtcgagtcttcgtgcagggtgatcgaagtcgccgccatctcggcgatccctccgggagaaaaggcgagaacagatgtaatcatggagatgcccgttaatttagaaaccgcaaccgcgctcagaatcatggcggcgattaatccgaccgaagaaataaatccgacggtcagcactctcgtcacgccggtgaacatgcttttgtacatttttgatccgattatggcgccgagaaaaatttgtgacagctggttcgcttccggcggccaccaggccagcatgtctttgcctgccaaggcggacacgccgatttccgcagcagcaacgccgatcatgctgccgagcagccaaggggcgggaaatttcagccgttttgcgcctttgcttgcaagccaggcagccaaaataaatccggccgttaacaagacgggaataaggcccgggtgtgaagctcctgccgaaacggctccggctgatgtctgagccgtaccgttttgtttggtaaataagaaaatgacgagaaacggtattgtcatgacgaccaaaaggacgcgcgtcagctgaataaggcttacaatcgcggtgtttgcgccgacttcctgggcgataccgggcatggcggataaaccgcccggcgccgtgcctacaaagcttgtcatcatgtccgtccggctgaaccgaaagagcgcatatccggaaacaagcgccatcacgatagagaaaatcagcatgaagcctaccggaagccaatgctcccgtaaaaccgacagaacggacaggttcagtttctggccgagttcgatgccgaggatcatttgtcccgccgcaagccatctgcggtgaatccctcttctgtcaggcgccatgaacagccagcggggcctcgtcatggagaggatgcagccggcggccagcgttccgagcatccaggcgatcgacatccctgtaagcgaaagaagaaacccccctgccgcactgatgagaataaaccagatatccgtaaggagatgtttgtctttcttcaatgaaaacccttcttcctgaaacattcatattaaattgttaagctcgttaaccttactattactatagtatagattttgagataaataaataatgaattatttctcataatccattcatttttcttatcacaaacataaaaaaagctccggagatgggtgagtgcaccctactccgaaacctcgcccgcttttcctttccacacaaaggtcaatcccagaccgagaaataaaaccacacctgcgaacagaaacgggaagtgaatattcatatcaaataaaataccgcccagagccgggccgaaaatggtgcccaaactcgtgtatgttgagttcataccggcaacaaacccctgctgatttcctgcgattttcgataaataagtagtcagtgccgggcgcagtaaatcaaacgcaaggaaaatgatgcaggtgacagcgagcacgggcaaaaatcctgacatcaccgtagaaacgaaagccagcacagcgccgatgatcagacaaagctgaatgacttttttctccccgaggaagttgacaagtctgccgaatgcgagcacttgaatgaggaccgccacaatggagctgaacgtaataataatggcgatatcctttggagtgaagccgaatttatggtttgtaaataagctgaataccgtttcgtacgccgacagcccgaatgccaaaacaaagacgatgataaaggcgatcaagtagcttggatgaatcgactttttcaaatcttttaagaaggttgattctttgacgctttccatctgctttgcgcgttcttctttagttaacggctcttccagcataaagacagaggaaatcactgcgataaatgcaattcccgccgcaaagaaaaacggcattcgaacgccgtgatcggcaataaatcctcctatgccgggcccgatgataaaccctgtgctgatggcggcagatacatagcccatcgccttcgatctttcctgcaccgtcgtaatatctgcgacatacgctgtaacagcgggcatgataaaagcggcactgatgccccccagcacccttgcgaaatataaaatggagacatgtgtgcccaatccgaaggtcagttcggataatgcgaacaaaaacagtccggcgagaatcatgatttttctgccgaagcggtcaacccatctccccgcaatgggggatgcaattaattgcgcgacggcgaaggcagcgacaaggtatcccattgtgctgcccgtcaagtgcatcacattcataaacagcggcataacgggaatgatcaatccgatgcctaaaaacgcaataaatatgttgcttaataagatgatgagtacagccttttgttctctgatcggtttttgcatgttgtttctcctttgtcagctgtcattctgtttatcagcgctgatcgacccgtgaataaacgcggagatggcttctttttgcaattcgattctttgctgaatggtatcgtttttatatagcacatctaaaccgtagaagacggatagcaggattttcacttttgattcgacatgatgaatggaccagctgccgtcttgatttccctcttctaagatctccctcatcacatcgtcatattcaatatcaattttgttgagccgctttacgacctcctctgacgtaaacgcactcgcataaaactcttcacttgctctcataagcgggtaattaatgctcatccggctgagcagctccgcaaagcccgccagtttttcggcagcatctttcagatcagcttccatttccctccacgtctcgatcatcacgcggtgatcctcttccatgatatgaagaaacagaaactcttttcctttaaaatggtgatatagattgcctttactgatttcggccgcctctaaaatatcccgaatcgatgtttctgaatatcctttttttgcaaataagtcacgcgaagcggatacgagcctgttcttcgtcttttcgctctttccggcaccgccttttgtatttgtcacttcacacagatcctttccgcctcattcatatcgttgtcccggcaaagcggggctcggttcgtttaaaaccgaccagttggtttattttattataaagggtttttgctgattatacaatgaagaaggtatccattgtttagagggagtataaaacggctcgaaaagtaaaccccattctctcatgttgaaagaacggggtttgtcagcggtctgaagactcccggcgggggagcgtgatctgcctgaaccgttatttgccggtatttacctcggtgtagcttgtgttcggcgcgtttgataccgttccccctgtatggtggaaaggagagtgggccatatcgtataaaaaccagacggcatgacgctgctcgtcaaatgctgtgcgggcaaataaccgcttcgcttccggatgcaccgctctatcggatgcctgcaaataaaaatcattcgttttctgctcatcataaaacgccgccctcagtccttctctgtatgtgtgcggacaatgctccgtctgtttcggcgtcaactgttttccggtaattgacgtatacagtgaagagaaagcgtgcaggtggcgcacttcttcctctctgatatgttcgattcgtcttctgatttctgcggtcggcgctttttcggctaatattgagtagcaaatcacagcgctgtattcaccgtttatggattttaccagatcctttataagcacagaatcgtcactgcagatggctgtataatgaaaaaaattctcgtgcattggactcacccccgaatgtttatagggtattatacggcggcagcccgtgacatgtgcggatgtcatttttattcttgatctagcggcgatgtaatatggtcgtcgtatgtgtcgacaaaaagccggccgttgcttccgcgcacagcgtatacaacgtcttccggtttgaggtttctcttgtccaattcttctctcagccatttttccgatacgtggttttcttccaggtttttcaccaccagccggccgtccataatcagctcaacggcaaagttcttttcatgtccggcaaaaatgccgagatcctgtcttgtaacgggcgcaaattccggtttgacctccactgacatgctgccgtttgtttcaatgatggcagtctgaacctgagaaatgtcaaatacgtcatttacacgcagctgctggttcaagtagtcgatggtataacgcatcgttttcatattatgctcaagtattttaccgttttgaatgataatggtcggtttgcctgcaaagaaacccctaaggaccctgtttttcatagaaagatatgcgacaaggtaaatgattgccacgaaaataatgtaggcaatgacatgataatgaatcggcagctttgtattaaacgacagatttgccgtgatggcgccgagcgagatggccgcaatgaaatcaaaaagcgtcatctgtgaaatggtttgtttaccgagtatccgggcgccgataaacagaatgctgaacgacagagccgtccgtacaattacttcgggatattctgacatcatcattagtccttttttctttattttggtcaaaaacgaaattttttaaaacagtcatcccgtttttaccagcagatgagattggtcattttcgtcaactttcgataaaatgtagaaagataaaaagagaggggtcttttaatttgggtgttgagtttttagtaggcagatcggggagtgggaaaacgaggctgattatcgacagcattcaagatgaactgcgccgggagccgttcgggaaacctatcatttttctagtcccggatcaaatgacgtttttaatggaatatgagcttgctaaaacgccggatatcggcggcatgatacgcgctcaagtgttcagtttttcgcgtttggcgtggcgcgtgcttcagcataccgggggcatgaaccgcccgtttgtgacgacgacgggtgtgcagatgcttttaaggaaactgattgaagaatataagcacgagtttaaagtgtatcaaaaagcgagtgacaaaaccgggttcactgagcaggtggaacggatgctgacagagtttaagcggtactgtattgagcctgaagatgtccgccgcatggcggaaagcggaacggcgtcagaatatcgcggagagcggatgctgtctgaaaaacttcatgatttaggcattttatatcagcagatggaaagaagcctcgccggacactatttgcattcagaggactatttgacgctgctcgctcagcagattcctttggcggacgttgtaaaaggcgcccgtgtttacgtcgacggattctatcaatttacgccgcaggaattaagggtgctggagcagctgatcatgcatgctgaacatgtcacattctcgctgacggcggacagcccttcggcggaacaggcaccggatgagctcgatctgttcagaatgacgggaagcacatactataagctttatcagacggcaaaggaattgaatgccgatatttcctgcaaggaactgcatggcacgaagcggcatcggcatgtgccggagcttgcctgtatagagtcgcagtacgatgtgcgtcccgccgcggcgtataccggcggacaggaagcttttaccgtcatgcaggcgcaaaacagaagagctgagcttgaaggtattgcccgggaaattcaatcacttgtccgggacggaggataccggtacaaagatatggcgattctcatccgtcagccggaagattataaagatttgctgaaggaagtgtttgccgattacgggcttccttattttatagacggaaaagcttctatgcagcatcacccgcttattgaattcatccgttcaagcctggatgtcgtgaaggggaactggagatatgaagcggtgttccgctgtgcgaaaaccgaactgttattcccgcttgatcagccggagcagaaaataagagagcaggtcgatcagcttgaaaactactgtatcgcctacggcattaaaggggagcgctggacgagcggcgagcggtttgtatacaggcgcttcgtatcgctcgatgaggatttcgcgcagacagatcaggaaatagagatggagcaaatgctgaatgagacgaaagagtggatggccgcgccccttgtccggcttcaaaaccggatgaaaaaggcgaaaacggttcaaagcatggcggaggctctttatctctttttggaagataccgatgttcccctgaagctggaccgaaaaaggcagcgggccgaagaggccggaaacatgatcgaagcgcagcagcacggccaggcgtgggatgccgttatccagcttctcgaggagtttgccggcatgatgggtgaagatgaaatatctttggcgctgttccagcaaatgcttgaaacgggaacggaatcgcttcatttttctttaattcctcctgcgcttgaccaagtatttgtagggaatatggatctctcaagaatgtacggcacgtcctgcacattcgtcgtcggggccaatgacggcgttcttccggcgcgcccggatgaaaacggcgtgctgtctgatgatgaccgggagtggctgaaagcggtcggagtggagctgtcttccgcggggcgtgagcggctgcttgatgagcattttctcatctatatggcgctgtcgagtccgtctgaccgtctttatgtgtcatacccgattgccgatgcggaaggaaaaacgctcctgccgtcaatcgttgtaaacaggcttggcgagctgtttcccgatcatcaggaaaagctgtcagcggctgatcccgagcaggtaagcgaagaagagcagcttcagtatctcgtcaatatacaggtggctcagacatatacggcaagtcagctcaggctgtggacaagagagtacgagatcagtgacgtatggtggagcgcatacaatgtgctgatgaaagagtctgatcaccaacgtgcgaaaaagctgttttcaagcctgtttttccgcaatgaggcgaagcgtcttgaacggcctgtttcgcgccagctttacggcgagcatattaaaggaagcgtctcccggatggaggcgtttaatgcctgccagttttcccattttgcatcacacgggcttcaattaaaagagcggcagtttttcaagctggaagcgccggatatcggccagctgtttcactccagcctgaagctgatttcagaccggcttcgtgagcagaagctggaatggcgcgatctgacgaaagatcagtgccggaatttctcctatgaagcggtggaacggcttgcgccaaagctgcaaaaagagattctgctcagctcaaacagacacttttatgtgaaggaaaaactgcagaagatcgtcacgcgtgtttcaggcatattaagcgagcatgcgaaggcgagcggtttcgtcccggtcggtcttgaactcggtttcggcggaagcgggccgctgcctccgctcactttcacgctgaaaaacggctgtacgatggaactcgtcggacggatcgaccgcgtggataaagcggaaagctcaaaaggcctgctgctgagaatcgttgattataaatcaagcgacagagggcttgatctggctgaggtgtattacgggctcgctctgcaaatgctcacatatcttgacttatcgattacacattccgcggattggctcggcatgaaagcgacaccggcaggcgttttgtatttccatattcatgatccgatgattcaggccagtctgccgatggggcttgatgaaatcgagcaggaaatttttaagaaatttaaaatgaaaggccttctcctcggtgaccgggaggcgatcagcctgatggacacgacgttggaggaagggcgttcaaatatcgtcaatgccggtttgaaaaaggacgggtctttaagatccgactcagccgcggtcagcgaacaggattttcatctgctgacagaccatgtgcggcggacatttgaacaggcgggcgaagcgataacggacgggcttgtgtccattaccccgtataagctgaaagataagacgccttgtacgtattgtgcgtttcaatcggtgtgccagtttgatgagtcgcttaaggaaaatgaataccgcagcctgaaagcggaaaaagacggcaccatactggattggctgaagaaggaggcggatgatgatgcaaattcctaaaccgaaagacagcatatggacggatgaccaatggagcgccatcgtttcttccggccgcgatattctggtcgctgccgcagccggatcaggtaaaacggccgtgctcgtggaacggatgatcagaaagataaccgcggaggaagatccggttgatgttgacaggctccttgtggtgacctttacaaacgcctcagcagcggagatgaagcatcggatcgcggaagcattagaaaaagagctcgccaaaaatccgggatctctgcatatcagacggcagctctctctattaaatcgggcgagcatttcgacgcttcactctttctgtctgcaagtgcttaaaaaatattattatatgattgatcttgaccccggttttcggatggctgaccagacggaaggcgaattgctcggagacgaagtgcttgatgagctgtttgaagatgaatacgcaaaagggaatcaggcgttttttgagcttgcggacagatatacgacagacaggcatgatctggatcttcaagaccttgtcaaacgggtgtacgagtattcccggtcgcatcctgacccggaagcgtggctgcaaagctttgtccgcctgtatgacgtgacggaagaaagcaaaatagaagagcttccgttttaccagtatgtgagagaagatgttgaaatggcgctcttcggggcaaaacaaaagcttgagaaggcgcttgaactgacaaaagcgcccggcgggccggcgccgcgtgctgataattttctggatgaccttcagcagatagaagagctgatcagctgccggcatgacttcgatgcgctgtatgaacgggttcccgcagtctcatttaagcgggcgaaggcggtaaagggtgatgaatttgacaaagcgcttttggacgaagcgaccgatttgcgaaacggcgcgaagaaactgatcgaaaaggtaaagacagattactttacaagaagtccgcaagatcacttaaagagtttagcagatatgaagtctgtcatcgaaacgctcgttcagctcgtgatatcgtacggaaaacgatttgaagcggcgaaacaagaaaaatcaattattgatttctcagatttggaacattactgcctggcgattttaactgcggttgatgaagaaggcaggcgggtgccgagcgaagcggccgtttattatcaagaccagtttcatgaagttctggttgatgaatatcaagataccaatcttgtgcaggagtctatcctgcagcttgttaaaagcggggatgaagaggcgggaaatctgtttatggtaggcgacgtcaaacaatcgatctaccgtttcagacttgccgagccgctgctgtttctcgggaaatataaaaggtttacagaaagcggggaaggcgcggggcagaaaattgatctgaaccaaaatttccgcagccgctccgatattttggacagtacgaatttcttgtttaagcagctgatgggcggaaaaatcggcgaagtggactacgatgaacaggcggcattgaagctcggcgcatcgtatccgccgaatgacgcggccaaaacggaactgctgctgattgacagcgctgatgacgcagacagcgccgaggatgccgaagactttgaaaccgtgcactgggaagcgaaagcgatagccggggagatccgaaagcttgtctcatctccgtttaaggtatatgacggcaaaacaaaaacacaccggaatatccagtaccgggatatcgtgattttgctgcgctctatgccgtgggcgccgcaattaatggaagagctgaaaaaccagggcattccggtgtacgccaatttgacgtcgggttactttgaagccgtggaggtggctgcggcgctttcagtcttgaaggtgattgataatccgtatcaggatattccgcttgcttccgtgctgcgctcgcccatcgtcggctgtgacgaaaatgaacttgcgctgatacgccttgaaaagaaaaaagcgccgttttatgaagcgctgaaagcatatatagcgaacggtgacaggcatgatgacctgtatcaaaaactgagaaccttttatgacagtctgcaaaagtggcggtcattttcgacgaatcattcggtgtctgagctgatttgggaagtataccgcgataccggatattttgactatgcaggcggcatgcccggcggaaagcagcgtcaggccaatctgcgcgtcttgtatgaccgggcgcgctcgtacgaagcgacggcgttccgcgggttattccgctttttgcggttcattgaacggatgcaggagcgcggcgatgatctggggacggcccgggcgctcagcgagcaggaggatgtcgttcggctgatgacgatccacagcagcaaaggacttgaattccccgtcgttttcaccgccggactcggcagaagttttaatatgatggatctcaacaaatcatacctgcttgataaagagctcggtttcggcacgaagtacattcatccggaactcagaatcagctatccgactctgccgcttgtggcgatgaagaaaaagatgcgcagagagctcttatccgaagaattgcgcgtattgtatgtggcgctgaccagagcgaaggaaaagctgtttctcgtcggttcctgcaaaaaacgggaaaaacagctggccaaatggcaggcgcaagcagaccgggccgattggcttctttctgaattcgaccgctatcaggcgtcatcttatttggactttatcgggccggcgctcatccgccaccgtgacatggaggcgcacaggacgccgggactttcatcgtctgaggatatcgcgcgcgacccgtcgcgttttcacatccggatgctgcagcaaagtgaattgctggaagagaatccaaaagaacgtgctgaagaaaagagcaaacgtctcaaagcgattcagcagggcgagccgattcctggttcgttttcatttgatgatcaggcgcgccgtctgcttgaatgggaatatccgtaccgagagctgacggctatcagaacgaagcagtcagtttctgagctgaagagaaagcaagaatacgaggatgaatacagcggccgctctctcatcaaaccgtcaggagacacgcttttatacaggcgtcccggttttatgatgaaaaaagggctgacagccgccgaaaaaggaacggcgatgcatacggtgatgcagcacataccgctgacgcacgtgccgactgccgaagaagcggagcggacggtccggatgctttacgaaaaagagctgctgacagaagagcagcaggaagctattgatatagaagaaattgttcagtttttcggaactgaaatcgggaaagaccttctcggggcgctgcggattgaccgggaagtgccgttcagtatggcgcttccggccggcgaggtgtacaaggatgccgaaacggccggtgaaccgctgctcgtgcaggggattattgactgcctctacgaaacggcggacggtctctatttgctggactataaaacagatcggatagaggggaaattccggaacggatttgaaggcgcggctccgattctgcaaaaaaggtatgaaacacaaatcgaattgtatacaaaagcggttgaacaaattacaaaaacgaaagtgaaagggcgtgcgctctatttcttcgatggaggtcacgttcttacactgtaacaagatccgaagctcctttttggagcggatctttttttctatcaaaaagtgaggtgaatgcggtatgcgcattttacatacagctgactggcacctcggcaaaacgctggaaggcagaagccggctgagcgagcaggccgaggtattggaagagctgaataccattgtcaaggaagaaaacattgatgcggtcattatggcgggggatgtatttgatacggtcaacccgcctgcgctcgctgaacaattgtattatgaaagtctttccgcgctttctgacggcggaaaacgaccggtcgtcgtcattgccggaaaccatgacaatcccgacaggctggcggcggcttctccgttaacaaatgagcgcggcattcatttaatcggctatccgcggacagaacccgtgcatattgaggtgccgtcggcggacgagctgttagccgtagccgcgctggcatatccgtcagaggcgagattaaacgaagtgctttctgatacgtttgaggaaaagcttcttcgcgatcattacgatgtgaaaatcagagaggcgtttgctcacatgtgcggactgtgccgggacgatgccgtgaaaatcgcggcgagccacatttatgtcgcggggggaaatcagaccgattcagagcgtccgattgaagtcgggggcgcttacacagttgccgctgacagcctgccggctgatgcggcttacgtggctctcggccatctccaccgtccgcaaacgatcaagcgcgccaagacggctgcccgttattcaggctctccgctcgcatacagcttttcagaagccggttatgccaaatcggtgacggtggtagaagcgaagcccggcggagaagcgaagtgggaagaggttttcctgtcttccggtaaaccgctcgtcaaatggaaagcgcaggggctgagcgaggttcacggctggctcgatgaagggcgtgaccggaatgcctggatcgaccttgatatccatttgacggatcagctttctctcgaggaaattcatcggctgagaaaggcgcatcccggctttatccatatcaggccggtttttgaagaaaaagagaccgaaaatgaccggattgaagtgaaacacacatcaattgaggatcgatttaagaagttttatgaaaaacaaacgggcggcggcgtgccggatgaggagatggtcaagctgtttttagagcttgcgtcagcagatgatgaggaggatgcgacatgaagccgattctgttaacgataaaagggctccacagcttcagggaggaacagaccattgattttgccggactgtcaggagccggggtgttcgggattttcgggccgaccggaagcggaaaatcgtcgatccttgatgccatgacactcgctttatacggaaaagtggagcgcgccgcaaataatacgcacggcatcctgaatcatgccgaagatcagctcgccgtctcatttacattcgcgcttcaatccggccaccgggtttcctacaaggtcgagcgcgtttttaagagaacggatgaaacgaaagtaaaaaccgccctctgccgcctgattgaaatcaaagacgaacaaacggtgctggccgataaagcgaatgaagtgaacaaaaaggtagaggagcttcttggcctgaccattgacgactttacaagagccgtcgtgctgccgcaaggaaagtttgccgagtttctgtcgcttaaaggcgcggaaagaagacatatgctccagcgcctgtttaatctggaacagtacggggacaggcttgtcaaaaaattgcggcggcgggcgcaggaagcggcagcgaaaaaaaatgaaatgctggccgaacaatccggcctcggagacgcaggagaagatgcgctgaagcaggctgaacagcagtttcacgaagcgaacgaacggcttgaagaagctgagaagaaacgggtccgggcaaaagagcgttttgaaagtcaccaggaaatttggaacttgcagacagaaagagatgaatatgagcgccgggagaaaaagcttgaggaaagacgcccgtacatcacggatttgactgagcgtcttaaagaggcggaaacagctctcgcccttgagccgtacgcagaccgctacacagaagccgtccgccggaagcagcgcgccgaacaggagcacgaactggccaaacggaaatcagaggcggaaaccgtttcatttacccggcaaaatgaagcctatgaagcatggcgggcccataaggccgaacaggagccgaagcttgtcaaggaagaagagctgtatcaaagactttcagccattgaacaaaaactgcttgaagcgaaaaaagaagcggaaaaaacaaatgcggaacacagcaaaaaagaggaagaatacgaagccgcctcgaaacagctggccggagtgaaagaccgcctgacccgcggtaaaaagaggcagaatgagctgaaagaagagctgaaagcagttcaggtgaccgccgatgaacggaaaaaatgccagaccgcagcacagctggcggcgggctttcagcagacacaggaacaaatcacgaaagaacgggccaatctgacaacgcagctgaaaaacgtggagaagctgaacggagaaagcgagtcgctcacagcgaaggcgaaaacggaagaggaagacattacgcacgcttatcaaacgcttcaaaccgtttaccatatggtctgtgaaacggaacgttcactgaaagccgcagccgaacgggctgacaaaacgcaagccgatctccgcaggcgctcagaggaagcgagaacggctgcattaacaaaagaattatcggaaaaactaatcgaaggaaagccttgtcctgtatgcggctccacgcagcatgaccgcccgcgttccgctcatgaaacattctcgcctgatacggctgtacaggaacagttgcagcaggttgaagcgctgctttctaaggcggcggctctttctcaggaagtgctgacagccaaggttgcattagaagagcagtcagggcgttttaccgaagaatgtccgtttctgcaaagcgcccgggttccggagctggaagccgctttctccatcagcggacgcccgcttgatgaagcgttcagcgccgtccgcttggaatggaaacaaatgaaacaggatatgctgtcggtaaaagagaaggtcacaagactgatcagcgcgcatcagcagacggtgaaacaagctgagcagctggccgaacgaatccgctacgaggaaaaagaagccgaccgtctcagacattcattagaagagcttgaatcgctgtcagaaagccgattgaatcagtacaacgaagtctgcggtgatattccgccaaaccggattgacgcctggcaggcttcgatagatgagaaggacaggcaggcagaagaatgtgagaagcgcattgaaacaagcatcgcattcctcaaggaacatgaagaggagaaagaacgcctgcaggagatgaagcatcggcttgaacgggaacggctcgagcttcactatgcgtctgagcgcctgcagcaggtgattgatggatatgaacaagagctcggaacagcagctgaagaaacatcaatttccgcaaagcttgaagcggtgcggcaggaattacagctgttaaaatcgaaagagcagtccctattcgatgcgctgaagcgggcgcagcaatcactgaatgacgcaaaaggccgggaatccgggagtctcatgtcactcagggatgctgagacttcccttgagaaagcgcaaaacgactggcgcgtgaggtcaaaagacaccgggtttaccgagccggaccaagtcaaaaaaagtctgcttccgcaagggcgtgcagaggaaatgaaaaaagaaatagatgagttcctggacacctcaaaacagctatcggcaaatatcagccgtgttactgataaattagccgaccgccggatatcggaggaagaatggacagcatccgtttctctgctgaagcaggcagaggctgagtcaggcgccgccatggaggaaaaaggagcacaggcaaaagcctacgcggttatgcaaaaacagcataagcgctttaaagagattgaagccgaactgaaaagctggcagacacagattgacaggcttgataagctccagtctgtatgtaaaggcaatacattcgtcgaatttttagcggaagaacagctggaaagcgtggctcgggacgcctctgcccgtctcggagcgctgacaaggcagcggtatgccatattagtcgattcagaaggcggtttcgtcatgcgtgatgacgcgaacggaggcgtcaaaaggcctgtatcaagcctttccggcggggagacgtttctgacatcgctgtcgcttgcgcttgccttgtccgcccagattcagctgcgggggcaatacccgctgcaattctttttcttagatgaaggattcgggactcttgaccaagggctcttagacaccgttgtcacagcgctcgaaaagctgcaatcggacaacttatccgtcggagtgatcagccatgtgcaggagctgagagcgcgtctgccgaaaaaattaatcgttcatccgtccgaaccgggcgggaaaggcacccgggtcacattggagatcatgtagaaaggagaaggaattatggccgattctgccgagggcacatgtgaattatgcggccgccatcatgtgcggctgacggagcaccacttaacgcctaaggaagaaggcgggacattccttccgaccgcaatgctctgcatcccttgtcataaacaggttcacgcgctctatacgaatcaggagcttgcggcaaggctcgcgggaatagaagagctgcggcgtgacccgaaactcgcgcggtttgtgaaatggatcagaaaacagccgccaaaaaagcttgtaaaaacaaaaaaagcaaatgaacgaacataacgctgaaccaaaagcagccctcttctgaaagagcggctgctttttaggcgtttccgaccacattttgatcgctgacatcggggtctatatagtttgtcgcattgacaacgttgtttaataacaggaaatctccggtattgcctgctcccgaaccgagcgcagatttagaagagctttttggagaaaggtaaaaggaatcaccaaagtttacgactccgcccgatatggaattgatagctataggtccggtaattgctggcataaacgacaccctttatagaagtctcaccgtcattatatgtcagggctgctgtgattgtgagcttgatgtgaagatctgcctaatatgtttcagccgcgaatctcccagaacgatcgacgtcgatccgatttgaaccacggacgctgacgataccccttgaactttcacattccttacccgaattgaagggttttcatggcagaatgcgctttggactcccgtttccggtaacggcatgacggccggctgccgaaagatctggtattcttttttgttaaatgagccttcatcatctctgtatacagcaagactacgctgatcggccaatactttgacccgcatattgatttcattcgtatcgcctgcttgaaagacactcgcaatcccgactgaattgattttggcgttccggaggcgtgaaatgcgctttaacattattccggcgccagcggcacataagggccgataataagagattccggaggcgtgtcaaagatggaagacagatagacggaatcggtgtcgccgattaataataaggaagaactggatacaccggtagaccggatgtcgccgacttcaatattccggttaatcactgtaaaaatcatgacggatcatcacctttcatttcaccaggtatgtgcttaataaagtgctcgacggccctgacaatatcacgcttcacatgttcggcaatctgctcggcatattgcgcgggcgccgtattttcttctttcgggacatgggacagataatacttaatccggctgtccatctgctttctgatatcttcaataatatgatatttgttcgcttcgtccagcctgctctcatactgagtttcgagcttctctaaaagcgcggggatttcttcattcaggtacatatcgacgttttggcggatttgctgcatttgctggcccgcctgttcctgctgcatcattccgacctgcggagatgtctggccgacttcgaagttttgcacggcattcggatcagtcggattcaatccgatattcagcgttccttccagccgttcaattttcagctgatcaaatttatactcgagccgatcgattcttgtagaaggctgctgcttcagcgttgaaatttcattttggaattctttcagctgccgttcgagctcctgaatctgctgcgcctgctgctggacgaaagaatttaaattctgcaggtaggatgaaacggattgatcatacatgacattcacctcgcgtctcgtttccttcattaaaactaccggcttggcggctggagcggtacaaatgatgaggtgccgggacctccccctgttgttacagtctgctgccctgcagtgacaggcggcgccggctcaacataactccctgtattgtacagattggaaagagatttaattgaaccggcgcttccgatttgcagtatggaggaattgctgacagattctacacgcatgtaattgatatggatcgactgattgacgtaaaaattcatacggcgcctcctttatgcgtttcctgccatcggctgatcgattacatcattatcgtacacattcgttgaattcctgtaattcgtcagtgtgagattgtctccggtattgaagctgcccgctccggcaaatgtcttaacctctgcttttggagaaatggtgatgcagtcgcctatatgaacgactccgctcgtaccgacggcattaattttaaacgctccgacaattgcgggcatacgagcacatccttttcgtgaagattttcatgactatactccaggagcttatctgggctgcctgcctaaaatagcttatgacaaatgcacatttttgtgagcggaaaaaactttagacgtaaaaacaccggcgctatacgcatgccgggccttatacataaatgatacagatttatatacacatcacgtttatgagaaagcctcttttttttcgcggccgtgctgaatctgtgcggccgggttcggcccgctgtctttcgtttgttggatgagcccgccccggcacccgtttaaaaggctgtccagctcctggctgcacctgatggtctccgtcgcattgattccgaatttttgcgctgtctcgaataaagttaatcttttttcttcaattttgttcatcgtgtgatctccaattctcgattattttggaaaacataggatgataatagtataacccattttggccaagaaggttttatttcgtcaatatgactaaaaaagtgacaatttttgatactcttttacacttattttcagcctgtttaaaagagggatttcccgttcggaggaagaatacataaaggaatgccatttaaaaatgatgggggattaacatgaaatttgcgacaggggaactgaacagccgaaaatttgtcggtctgattattgatgatgacaaaatcttagatctgcaaaaggctgaaaaaaaattgtttgaacttgagacgattccgggttcgctgatcgagtgcattcaaaaaggagataagtttgtcgcgcatgccggacagcttgcggaatgggcgaaaaaaccgaatgacgaatcaggttcatttatgtatgcgctgtctgacgtaaagctttgcgcgcctattccgagaccttcaaagaacgtgatctgcatcgggaaaaattatcgtgatcatgccgttgaaatggggagtgaggcggatatacccgagcatcccatggttttcacgaaagccccggctgccgttacaggacacggagaaacagtggacagccacttggatgtaacggagcagcttgattatgaaggggagcttgcggtaatcatatcaaaaagcggatcgcacatctccaaagaacatgcgcttgatcatatattcggctatacaattgtaaatgatatcacagcgcgcgatctgcagaaaaaacataaacagttttttatcggcaaaagcctggatacgacatgcccgatgggcccggtcattgtacataagtcggccgtcagcgatccgcaaagcctgaaagttgaaacgcgggtgaacggtgaactgcgccaatcaggatcaacgggtgacatgatatttccgatagctgaattaatcgagacgctgtcaaaaggaatgacgcttgaagccggtgacattatagcgacggggacgccgtccggtgtcggaaaaggatttaagcccccgaaatttttaaagccgggggaccgtattgacattacaattgaaccgatcggcacactgtcgaaccaaatcggataattgtgtgtctttcgcacgattgataatgctccgagaggcttgttgtggtaccataagtgaggcagattgatctgataggggggattgaacataatgacacattggcatattacttcatgggtcgttgcgcttatcctggtgtttgtcagctacgggctgtacggtgccggaaaagcgaagggcgcaaaaattacgcatatgattctgcgcttattctacattattattattctgaccggagctgagctttttgtccgttttgcgaattggaacggagagtacgccggaaaaatgctgctcggcatcattaccatcggactgatggaaatgctcgtcatccgtaagaaaaaaggcaaatcaaccggcggactgtggatcggttttattatcgtgctcgtcctgacggtgctgctcggccttcacttgccgatcggctttcacgtattttaatcaatcgcttgaaaaacccggatgcatccgggttttttagttgcgcatacattttgcgcaactgtgccagcgtcaatcactctcgttaccgcaaaagctacggctgtaaagggtaaaagcaaacgccgggcgtcaatcagcgtgaaaacaaagctaaatccatcaggcggcacctatttaaaaggtgccgcctgtttgttacgcggtgccgtcttgttttgccgttgaatacataatggagcgccgcccgtcagatgccgtccattcaaatctgtcgtgtttacccgagctgccgcggtgatgctgaagggcgcattgtgcgtcatccgccgagaagtgataaaacgaaacgccttcaccggaaaacagcgcctgattgtaggaaaatacgcaatcatatacagacaggccgaacccgtgcagatggctgagaaacagcagaaacgtttcatcgtccagcgaatcgagcaaggttaacagcggccgtttgaccgccttttcataacggatttcttccccgccgagcagggggatggtgtctgcgccgatttcggccgcaccgccgcaaatccgtgccggctgccatcggccgccgcgtttcatcaatacgtctgcgtttcctagactgtctgcaagcaggatatcgccttcatcgttttcgacgaggcagatgccgtcctctatcatcagggtgccgcgcccccatttgtttttttctgagaaaagctgttttcgtttcataaccgtgccggtctcctttgtttgtttcttctctttcgttctttccaaatcgggcttgtctcatacaactcttagtgggacaaatcaactatctgcgtttctttgcataaactgggtaaagtgctgatagaaacgaatttgataccgacagaaacgggattggagctgatatcacatgtgtggaattgcgggttgggtcgattttcaaaagcagctcgtccaagagaaacatattatgaacaatatgatagacactctttcaaaacgagggcctgatgattcaaacgtctggggagagccccatgttttattcggacataaaagactttcggtcgttgacattgaaggcggccgccagccgatggcctgcacgcatcaagaggaaacgtacacgatcatttataatggcgagctgtataacacggaggaattgcggaaggagcttcaggcgaggggccaccgttttgagaggacctctgatacagaagtgctgctgcacagctatattgagtggcgggaggagtgcgtggaccgcttgaacggtattttcgcttttgccatctgggatgaaaagcgcgagcggctgttcggggcaagagaccggctcggcgtcaaaccgtttttttataaagaacacggctcttcctttctgtttgggtcggaattgaaagccatccttgctcatcctgatgtgaaagcccgcacagacagcggcggacttgcggaagtattcggactcgggccgtccagaactccgggctgcggggtgtttaaaggaattcacgaggtgcgtcccgcccatgcgttcactttctcaaaggacggtttgtccatatggcgttattggaatgtaaagagcgaaaagcatacagacagcttcgatgaaaccgcggctcacattcggtacttatttcaggatgcagtgacacgccagctcgtatctgacgtgccggtttgcacgtttttatcaggggggcttgattcgagcgcgataaccgcgatagccgccgctcattttgagaaacaaggcagagatccccttcatacttattcaattgattatgaggagaacagcaaattttttaaagcgagcgcgtttcagccgaatgatgacggcccgtggatcgataaaatgacaaatgcattcggcacacagcatcataagtgcgtgattacgcaggatcagctggttgaacatctggaggaatccgttctcgtcagagacctgccgggcatggctgatgttgattcctcgctattatggttctgccgggaaattaaaaaagattttgtcgtgagcctttccggagaatgtgcggacgaaattttcggcggatatccgtggtttcacaccgcggcagaagaagacggatttccttggatgaggtcgactgaggagaggatcacgctcttggatgaaaagtggcaaaaacggctgaaccttagagaatacgtgaatgcgagatatgaagaaaccattgcggaaacgccgctgttagacggtgagacgggaacagataaagcgagacggcagctgttctacttaaatatgctttggtttatgacaaatctgctcgaccgcaaagaccgcatgagcatgggcgcaagtcttgaagtacgggtgccgttcgccgaccacagacttgtggaatacgtttggaatattccttgggaaatgaaaatgcatggcagccgggaaaaaggcattttgcggaaagcgcttgaaggactgcttcctgaagatattttgtaccgcaaaaaaagcccttatccgaaaacgcatcacccgaaatacacgcagggggttacagaatggctgaaaacgattttgcaacagaaagattccgtgcttcacaccctgcttgacagaaagaagctggaaatgctgctggagacagaaggttcatcttttcaggtgccgtggttcggccaactgatgaaaggcccgcagctgatcgcccatcttgcccagatccatacatggtttgaggcgtaccgtatcgatatagaagaataacagtgccgcgaccggtttccgctgaaggatatcggtctttttattgtgaaacatatggtacactaaaaaacagaggagtgataccatgaccgaatatgaaacatgcgcccagcttgccgaggcgcactttcctttatataaacggactttctcatccctgccgccaaaaaacaggcgggccgcatgggcggtgcttgctttgtttcacgaagctgatcggcttgatgtgcaggaacttggaggatttgaacaggcggcacaagactttctgaacggggcacgcgccgacggctttttgtgggaggcgctcactgatgtgcggcagcaatttgcgcttgaagaagagccgttgcgtgagtttatcgccggccacatctctgacagagaaaaagtaacgtatcaagagtttgatgacctgctgatgtacgcgggccaaacaggcggagccatcggcctgcttctgctgccggtttgcgcgcgccggaaccaagagaaactccgccatgcagccgtttcattaggagcagccattcagctgacccgggtgcttctgggggtccatacggatgagcggtcgaaaaagcgtctcccgcgccaggtgatgatgcaattcggctatacggaagaagagctggagagccgtactgtcaacaaagcttttatgaatgtatgggagtacatcgcattcgaggctgaggcgtatttcgaggaggcgtctgaagagctggagctgtttccgttatactcaaggcccgccgttaccggtgtgctggcacattaccggtcagagctcggtgacatgagaaaacggctttcgcaagcataaaaaaaaacgcccggcttcttaacgaagctccgggcgtttatgcaatccctttttgaatccaaatccgcgaccgccatcttctgtacataagaatgcccctgacccattcatccgcgataaatgaaatccagatgcccataagccctaatccgaaatggatgccgaacagataagcgagaggcagtccgataccccacatggaaatcatcgccatgtagacggggaattttgcatctccggcagcccgcagcgagttgatgataatgacattaaatgaacggccgggctcaagaatgatcgtcatggcgatcagcatgctcgccgtcgcaataatgtcagggctgcttgtgaaaattccgatcagctgctttgaaaacaaggtcatgatcacggatgtcaaagcggcaatgccaagcgcccagtacagacttttcatgcagcggtcataagcgtcgtcaaaccgtttggcgccgatatatctgccgatcaaaatctgtgtgccctggctgatcgccgttccgaacagcaggataaacatggtgatgttttgcgtataaacctttgttgtaagcgcctgagcgcccataatggcgataaaataagtgacaaccatttgtgaaatgttgtaagacagctgttcgccggcagacggaatcccgattttcaggagtttccgcaagtgctctttatggacgtgaaaaatcttttgccatgtcagaccgagtccgatgcgttttttgacgatcacaatcatcgcgatcagtccgatgatccgtgcaaaggacgttgacatcgcaacaccggcgacgcctaacaccggaaggccgagcggcccgaaaatgacaagaaagtttccggcaatatttaaaatattcatcccgatcgtaacgaacatcgtatccttcgtatgaccgtagctttttaaaatggcactgaatgtcataatcaaagcctgaatgaaggacagcccgccgaccacctgcaaaaagactttggcatccggcatcaattcattggaaagacccatcacatgaagcagcggaacggccgcaaaaaatatggcggcgctgatggcgagactgatgacaaagttcgctcctattgatacataagccacttcctgcgcctcttttttctgtttagatcctaaaaactgtgaaatcacaattgtcgtacccgtagcgataaagctgaacatcacgataattaaatttaaaatctgattgctgacacccacggccgccacactgttgtcagagtattggctaagcataagagtgtcggcgtttcccataaacatatataatgaaacctcaataaatatcggccaagtcagcgcgtataatgagagtttgtgatcagaggattgtttgaacgcagcccgttttaaaatcgcttgtttcatttcttttaacccctttcctgacaaaatcaacgtttaaaagtgtacctccattttcttataataaaaagggagagaaacgaaacttcttgcaaaaatccgacttaaaaaggagggccgaaaatatgtcctttctcgagttcacagttcctccgttcccggtctttatcgctgcgggagaaggagtgttcaaaaaaggcgaaacccatgtgagacgggtcttcccggtgtttgatctgctgtatgtgaaaaaaggcgtcctctacattacagaagacgaaaacgccttttccgttgaagcgggagaatatattctgctttctcccggccttgaacattacggaacaaaaggcagtgaagaaacgacatcctattcgtggcttcattttgaaggagcggcttatgaggtgacggaaacaaccgggaacaactggtcggagctgaggcgaaaaaaagggagctttgaagagccgtcccgctaccgcctgtccctgccgcaaaaagggaaggtgagacgcccgcagtttatggccgggcaattcagtgtgctgacagatgacagcgcagagaactccgatctgccgctcagaaagcagattctgtttgaagagctgctgctccatcttcagaaagaagcgttccaaatcccgtccgcaaaggaaagagtcgcatgggaggccgcccggtacctgcaggagcactatcaggagaaaacaaccatcaaagcgctctcttcggctcttcattacaaccaagactacgtgacccgctgcatgcagcaggtgctcggcgtcacgcccggccagtatacgaacaaagtcagaatgacggaggcgaaacgtcttttgtccgcaaccaatgacaaaatgggggcgatcgcggacgccatcggcatggaggacccaacctatttttccaaactgtttaaacagattgaaggcatttcgccgctcgaataccgcaaattcgtaagccggaaaacggactgacctaataccagagaacagaagagggatcggtaagcatgaaaatgacaatttacgacgtggccgaaaaagcgggcgtctccatctcgaccgtctcgcgggtcatcaacaatacggggaggatcagtgtcaaaacccgccggatggtgctccgtgtcatggaggagatggactatcatccgaatgttcacgcatccgctttgacgggcaaaaagacgaatatgatcggcctgatcaccccggatatttcaaacccgtttttcggggaactggcgaaaagcattgaagacagcgccggtgtacttgggtttcatatcattatctgcagcaccgattatcagcctgaaaaagaaacgaagtatttttcgatgctgcggcagaagcaggcggacggcattatattcgcgacgggacttgatcatgatgacagcgtcacagcgcttgatgatatggtgaaatcgggcatcccgcttgcgatgattacgcaggataaaccgctcgcgccgatggacgtcgtcattatcgatgactttctcggcggctatacggcggctgagcatctcatatctttaggccatgaaagaatcgcctgtatcgtcggaaacggttcgaccacgggtgaaagagacagaatcaaaggttttcaaaaagcgctgctggaagcggggatgacactagatgaatcgctgatcataccgacggaatattcgctggaaagcggaaaacaggcagcgggcgagctgtttgacagagaccttccgaccgccgttttcgcctttaatgatgtcttgtcatgtgcggcgatacaggcggcgcgctcccggggcattcgggtgccggaagacttgtccgtcatcggctttgacaataccattctcgctgaaatgacggcaccgccgctcacgacgatttctcagcccatccgcgaaatggggaggcgcgtcgttgaacttctcattgatgagattcaagggaagaaaaaaacaaaaagcaaaatcattttatctccggaactcgtcatcaggcattctacggcaccggtgaagacgcgccctcagcgataagggcgtttttttctgtgaaaaacattgtcaaacgagcgaaaagcattgtaaaattaaaacagctttggagaaagcgcttgcgcaaatactgcggattgcaagcaaagaaagccaacagtttgagttataaataaagcgctttcaaaataataatttctgtttaataagggaaaccgcttgcgccattgcggcatgcggcctcaagaaaaaaggagcggtgatagatgacagatcaagtcagatgtgcggtgctgggattaggacgattagggtattttcatgcgaagcatttagccggcgaagttcggggagccgaacttgcggccgtctgtgacccgatgaaggggaaggcggaagcgtgtgcgaaagaattaggaatcgccaaatggacggagagcccgtatgaactgctggaagatcacacgattgacgccgtcatcattgtcacgccaacaagcacacatgcggaaatgatcatgaaggctgctgaaaacggcaagcatatctttgttgaaaagccgctcaccctgagtcttgaggaatcgattaaagtcatgaaaaaaatcgaagaaacggacgtcatctgccaggtcggttttatgaggcggtttgatccggcatacgccgacgcgaaaagaagaatcgacgccggggaaatcggcagacccatttattataaaggatttacaagagatcaaggcgcaccgcccgcggaatttatcaaacatagcggagggcttttcattgactgctcgattcatgattacgacatcgcaagatatctcatgaatgccgaggttacgtccgtctgcgggcacgggagggttttaaagcacccgttcatggaggagtgcggcgatgtcgatcaggcattaacgtatcttgagtttgattcaggcgcggccggcgatgtggaggcaagccgaaattctccgtacggccatgacatccgcgccgaaataatcgggacggcgggaagcattttagtcggcacgctgcggaacagccatgtcaccattttaacggagtcaggcagcagctacgaaattattccggattttcaagcccgctttaaagacgcttaccgtctggagcttgagcactttgccgaatgtgtgaaaaaaggggaaacgccgattgtgacagacgtcgatgccacgattaacttagaaatcgggatcgccgcgacggaatcgtttaaaaccggaaggcctgtaaagcttaccccgggcgccttcggctatgccggactatgatagattcgaagtgaaaaagcaaaggcccgggaggcctttgcttttttatgattcgtatgagaaaaaaatgtagtcagtcggcacgcttttatagcccatttggtgaagcatcgcgcttatattgccgcgatggtatgtgccgtgattcacaacatgccggatcacatcggcatatgtcgtccggagcgttcccatgcgcggatgagaaatggagatcgggccttccgtgttctccaattcttttaaaaatttgctgtattctttgtccagttcagccattctatgttcaatcgcctcaaaatctccgtcaagcttttcaaattgatcaaactgcgagacgatttgttcgtaagtttctccgtaaagcacgtgaagccaaatgtaatcagcccggtatatatgcacaagcacggcgttcacagtcggaaaaacactatccagtttctgctgtaagcttgccgcgggcagggtcttcagatgctgaataacctgctcatttgcccatctgtggtagtgatacagctttaaaatgtctgacattccaattccccctcttccttccgtacattcaacatgacctggccgaattccttttatcgaaacaaaagcgccgcaaaataaaaagcagcaccccacatcaccaatgccgagcatttattcaggatgtcgaggagccggcctcctgtatccgccgtttggacgagccgtcccgcgaatgccagtccggcgaaccatacccaggaaaccgcgatacaagcaccggcaaacagccatttatcaattcccggataggcggcggagcttgtgccgatgacactgacggtatccaaaatcgcatgcgggttcaaaagggataccatggcggccgtgaccgcctgtttttttgccgagaaaaccgtttttttcgcctgttcggcctgcggtttgcttctccaagtctgccagcctaaaaaactgagaaacaaaaagccgcctataagcatgacggtctgaaaaacgggaatctctgcaataatcattgaaacgcctgcgacggccgcgatgatgagaatcgtatcgcataccgcggcggcaatcactgcgggaaacgcctgccacacatgtttttgccaggctccctgctgaaaaataaatacattttgcgcgcccaatggcaaaataaggccgaaagcgagcatcactccgtgaagaatggcattcatatcgtaaaaccctccaatcgtcaactaaatctcattgtagccgcactatgtgctgatgtctccgtccatttggctggtacttgaaccagccaaatgtataataaataaagaaggagggatgacgtatgaacagctggcgtccggatcgggagtcgtacataccgctttatctccagatcgaacagcatataaaagaaaaaatacttcatggcgaatggaccatcggcacgaaaattccctcacaaagaaagctcgccgaggagcttcaggtcaaccgaagcacagtgacggcagcagttgatgagttaatcgcccaaggtcttctggaaggaaaaagagggggaggcacaaaagtcgtcaacagtacgtggagcatcatggcagcggctaagccccttgattggagcacatacgttacatcggggagtcatcagccgaattcagccttggttcaggccattaatcaaaacgagccgcgtccggatctgatcaggctggggacgggtgagctgagtcaagagcttctgcctgagaaggagatggccgaactgttccgtgaagcgggaactaacatttttgcgctcggctatgaagagccgaagggcagcctgaagcttcggcaaagcgtcgcggaatatgtaaaaacaaaggggattcacgcgtccccggcatccatcgtaatcgtctcaggcgcgctgcaggcgcttcagctcatttcaatcgggctgctaaaaccaaactccgtcatgctgactgaaaacccgtcgtatctccattccctgcgtgtgtttcaatcagcgggcgtcaggcttaagggagtgccgatggatgagagcggaatcaaaacggatcatcttcccgcttaccgtcggcaatacgaagcggggctgctgtacaccattccgtcattccataatccgaccggaacggtaatgtcactcaagcggcggaaggaactcatcgcgctcgcaagaaatcaccgtctgcctgtcattgaagatgacgcatacggtgatatatggatcgataaagaaccgccgcctccgttaaaatccatggacggtgaggggaatgtactgtatatcggtacgctgtcaaaaaccgtaagcccgggtctgcgcatcggatgggtcgtcgcccctgagccggttgcagacaggctcgccgatattaaaatgcagacggattacggctccagcgctttatctcaatgggcggcatgtcaatggctgtcaagcggccgctatgaagagcgtcttttgcgtctcagaaaggaactcaaaatcaggagagatgcggcattgcgttttcttgaaagatacgcgggagatattgcggagtggcgtgtgccggaggggggcttttatatttgggtcaccttccataaagcattcaccgttcagacgcttttcatccgtgccttggaggccggcgtgctgatcaatccgggagctctctatcttcccgaagaccggcaaagcctgcgtctttcctattcgtacgcatctttaccggacttggaaaaaggcattcaaacgatagcggacattgcccgccgtttcgtttaataaaagatcacgtcacaatggcgccgagcgcttctgcgaatgtaacggcatgcgccggagagatgcggcatcctttcagcttatcaagcgagacatgcagatgatcaaatgtgcacgtgctgatatccatattaaaaagagacgtgccgatgaagtttgcgccgttcaaatcacagacgtcaagatctgtgtattcaagaacggaatcattccactcactttctgaaaggccgcacgagtcaaaacggacatgcttcatattggaatagctgaaggagctgtaatttgcgaggcagtcttcaaaccgtacatgacgcatggcggaatccgccagattcaagccgagaagttttgaatgctgaaacgccgttctatggatgatgcttccgctgaaatcagcgtttgagacatcgcatttgtcaaacaggacatccgtacattccatatgtctgaaagagacatccgtaaaaacgatgtttctgaaaatgactttttcggcacgcaggccgtccagtttgccgtttacgatgccgttttcaatgatgacttctttgagctcctcatcctgaagcgcttcagtgaaagaaagcaccggcaattctttcgggattttcggtttttggatcgtattcatctcatactcccttttctaaacataatagctgaaatcggcaattggcagatatcgctttctgcctgccaaccttgctgttgcgtaatgtacaaagggtattaaaaaagcgggagggcgtcaatagtgtcgcatataaaagcagacgtgacattcaaggtaatgcccttagagacatgtccccaagggcttttgtctgtttcaggcgagttctttatacatgatcacatgcgggccgatgccgggtatgtcaaaggggctgcccgtgcttttccagccgagcttctcgtaatatcccttcacgtgacatctggcgttgcaccagacaagcgccgcccccatatctgccagttttcgttccgcataggcgattaacgtgcttcccgctttttgcgtccggtattcttcaagcgtcgccatgccgcgcagctggtaggcgggcgccgcctgtaaagcctgctggttctgcgggtagaaagaagcgatgctgatcaatgtcccgtcgtaaaaacctccgagatgaaatgctcctttgacgctgtcctgatcatatttacaatcctcaatcgtctgatgggggcgcagcacgctgtgtctgatcgcgtatgtgtcttctgcggtgatgggttttacttcaaccataaaaaatcctcctttgtttgattctttttctgtatcgtaccatgaaaaagccgcctgtcatatcaggcggcttctttcgcgtcaatgcaaatatacatcagcccgcttttcatccttttgcttaatataagctgcaagctctgacgtcaaatcagaacggagaaacggggtgattaaataaattccgttaaacagttcgcacgccgtgtcgagaagcgatttggcgatggcgaggccttcggctttctgctttcgcttgtcttcgccggcgagcgccattttttcgcggatgctgtctgacagcttaatgcccgggatttcatgatgaatgaactctgcgttgcggctgctcgttaacggcatgattccgatatacaccggtgttttgagatgcttcgtttcatgatgaatgtcaatgagctgctgctccgagtagacaggctgggacacgaagtagtcagctccgcactcgatttttttctccagccgtttgactgctttatcaagatggcggacattcggattaaatgctccggctacggaaaagttcgttttcttgccgagcggtttccctgataaagaaatgccctcgttgaattgtttaatcagcctgatcaaatcaaaggacgttaaatcatagacggaggtagcccccggaaagtcaccgatttttgaaggatcgcccgtgatggctaaaatgtcggtgagcccgagcgtatccagccccattaaatgtgactgaaggccgatgatgttgcggtctctgcatgtaatgtgaacgagagaacggatatcaaggcgctctttcagcaatgaaccgcaggcggcattgctgatccgcggtgtcgccaatgaattgtcggcgagcgtcagcgcttctatgccggtctcttttaattcagcggccgcttgcagaaatttgtcaaaattcaatttcttcggcggatcaagctctacgataattgaccgtttttgagcggcgatttcgtttaaaccaggctcggtccgttcattacggactgagatgacttcctcttcccgtctgattttcacttctttatcagtgacaggagaaagtccgcggaccgcttcagccatggctctgatatggtttggcgtcgtaccgcagcagccgccgataatgcgcgcgccctgagtgcggaactgtacggcgctctcccggaaataggcatcgtccgtatcataaacaagccggccttcttctaaagacggaaggctgctgttcggatagaccgataaataagcgtcacggaaaatcggcacttcggtgagcgcttcaatcatgtggtacgggccgagccggcaattgattcccgctatgtcagcgccgagatcggcaatggacctgagggcttcccgaagcggcgttccgtcctgcagcacgccctgttcgtgcatggatacgttcagcataatcggaagttccgtttcttttctcgcgatcttcagcacttcgcgggcctcttctaaatcatagtatgtttccaggagcagaccgtccggctcttcgtgcagcaataaataaagctgctcccgaaagctgcgtttaatctcctccaggctgtaggcgtttttgttaaaggtgcggatgccgcccatcgttcccaatacataagcgccgtctgaggaagcgcgcgcgattctgaccgcctcctgattgatttttttcgtttcatcctcaagtccgtatcttgagagcttaataaaattcgcgccgtacgtatttgtctggatgatgtctgccccggcttccacgtaagccttatgtatccgcttgatttcttcgggctttgatacgttcagttcctcaaaacatctgtcaatgccgtaggaatagaggagagtgcccatcgcaccgtctccgattaaaatccgttcttctaagtcttgtaatagtcccattgtttgcctccttcatcacattcagcaaggaaaaaagagaaataaaaaaagtcttcttaagaagaagactttgtaatcatttgtctctcttcttatcttccaagctgtttttagcttgctggatttagcaccttggtcatggtttgggtaaaccactacaccggttgctgaagcgtcgtcgggccagtccctcggcttctcttgataagaacgttcatgtaattgtcatgggtttccaaaacttaactgtgaaaatccctttctccaaatttaccgaaaatagagacaataatcaataggaatcacataatttatctaaaattaataaattgaacgtcaatcggcaggtctgctccgcggacggctgcaataatctgctgcagatcatctttattttttccggtgacgcgcacttggtcgtcctgaatctgcgacttgaccttcaagccggagtttttaatcaccgcgttgatttttttggcgttgtctttatcaatgccctgtacaagcttcgcgcgctggcgcaccgtgcctcccgatgcattttcgattttgccgtattcaatgtttttcgtcggcacgtcccgtttgatcagcttgccgctcagcacatctttgagctgattcagtttaaactcgtcatcagaaatcaggacaagttcttccttttctaacttcacatcgcttttcgatcctttaaagtcatagcgcgtgccgatttctttcagcgtcatctgaatcgcattctgcacttcgggaaattcaactttggatacaatatcaaaagaactttcttttgccatgagaaaacctcctataacatttcacttatgagttgattatagtagaataaagagaaatgtccaacagcataaagcatgaatttatgcatattggaaaaaatgagaaaaacatcagcctcatacgggcgaatcaggaaggacgataacatgagaccagggcagcagctcacgcttagtatagatcaccaaaccgatttcggttattttttaaccgacggcgaggatacggttcttttacataacagtgaaatcacagaggatatcgaagacagagatgaagtggacgtatttatctacgtcgatcatcaggaaagactcgcggcgacgatgaaaaagccgctcatcagcttttatgactacggatgggtggaagtgacggacgctgtggaagatatgggcatattcgtcgacgtcggtctgtcaaaagacgcgctcgtcgcaacggagcacctgcctccgtacaaatccgtctggccgcaaaaaggagacaggctgtattgcatgctgaaggtgacaagccgcgggcgcatgtttgccaagccggcgcctgaggatatcatcagtgaattatttacggatgcagaggaagacgtcatgaataaagatctgacaggcacggtgtacagactgattgcatcaggctcttttctgattaccgatgaaggcatccgcgcgtttattcacccttcagaaagaaaagaagagccgagactcggcagccgcgtgacagggcgtgtcatcgaggtaaaggaagacggctccgtcaacatgtccctgctgccgagaaagcaggatgcgctttcggttgacgcggaagaaattctgacctatctgagatcaagaaacggcgcgatgccttacggagacaaaagccatcctgacgatatccgcgaacggtttcatttaagcaaagccgcctttaagcgggcgctcgggcatctgatgaaaaacggcaaggtctatcaggaagacggctggacatacgaaaaacaataaatgttctgcaaaaacatcggtgaaccaaaaccgatgttttttattttctcaaaagctgctatattcctcatttgtttaacaccctgccgaacatacatattttattgaaataaaatattctgacatccgaaccgatatataactatagaaaaaacaaaaggagagtttcaatgaaaaaaatggcgatatttgcggctgtactgctgattgcgctcagcacggcgggatgtgccggcaaatctgaggaaacggcggccgaaaaaacgaaaacaatcggcatcatgctgacagacaacggcctcggcgaccaatcatttaatgattcaggctttcaaggtttgatgaaagcgagagacgagctcggcatcacatttgactatcgggaaataaaagataccggtacatacgaaaaaggactgacccagcttgtccgggaaggcaatgatcttgtggtggggctcggttacagcatgcaggcggatttagaaaaggtcgccaaaaaatatccgaagcagcggtttgtgctgattgattccgtatcagacctggataatgtcacctccgtcacgtttaaagaggatgaaggaagcttcttagccggagcgctggcggccatgacgagcaaaaccggcacgatcggatttatcggcggttccgatgccgacgtcattaaacggtttaaaaaaggctatctgaaaggcgcggaatcagtcaaaccgaacatccgcgtactgtcggacatcagcggtacgtttgatgatgataagctcgggaagcgcatcgcccaaaacatgatccgaaaaaaagccgatgtcctgtttacggcggccggcttcacgggcgtcggcgcactgaaagaagcggaggcgcaaaaagtatacgccatcggtgttgacagcgatcaatattacaccgccgagcacgccgttatctcatctttagtgaaaaatgtcgaccatgtcatctatgaattggcgaaagatttaaaagacaacaaggagatcaaaagcggtgagatcgtttacggactgaaggaaaacggcatggtcttagctaagatcagagttgtcaaaaacgcaggcgggctgacgaaaaagatcacggatatgaaaaacagcctgattgaaaaaggaggcgatctgaagtgacattacggacaaggctgctcgttaacgcagccgttacgatgatttgcttcgccgccgtcatcggctttaccatcgtaaacatgatgaagattcaggcttcaaatgaagatgaagtggacactctgttaaacgtccaggaagcaaaagctgaccttaatacgttaaaagaaagcatcaccggctattcctatacgctcgcagacgctcagaaagaagatgtgcgaagctatatgaaaagcagctcagacaaactggcggcgctcgaaaaaacgatgacggacgatgcggacaaagccgcttatgacaaactcgccaaaaaatacgaatcgtggcaggcggaggcggacgctgctcttgattcgaaaagcccggctgaagcgacaaggacggcggcccgcatcaacggtcttctgaatgatatttatatgctgaatctgaaaagccgggatcactatgaagacatgcagaagcagacggctgaccagattcagtttatcgtttacagcgcagccgtgctgaccatcgtgatacttattgttaccgtcatatcttccattaggctgacgaagagaattgcagggccgatacgccgcatggctgaaaatgcccgtcgtattgcgggagggaaccttgctgttgaaatgcttgattataaagggaaggacgaactgaaagagctgaatgactcattcggaatgatggctgaacagctccgcaccttaattcaggcgatcggagaggtcggccgtgaagtcgagacgtttgcggaaggtttgacgaaggaaaaccagacgctgaaggacatgaccgagcaggtgtccgtgtcgacggaagaaatggcgcaaggctcccaaaccatttcagaagatctgcagcatgcggtgcaattcattgaacaaatggatgaacattcaaaggcgaacgccgaacgttcaaaacaaacgacgagaagcagcgaagagacgattgcggcggtggctgcggggcgcggtgctttagctgagaccaagcaagccattgataaaagcaatgagacatcaaaagagatttccgaagccgccgatctcttcatagagcatgcggcaggcatcagtatgatggcgcagaccgtttctgacattgcgggccagaccaatctgctgtcattaaacgccgcaatcgaggcggccagagcaggcgagtccggaaaaggatttgccgtcgttgccgaggagatacggaagctcgcagacggatcagccaaagcgacagcgcagattttcgatatggtaaagcaaattgaagacggcatcacgtctattaccggagctgtcacgaccggcgtcgctttagcggacagacagcaggagctgatggagaaaacgtcagaatcattcgcccatattgaacaaaaagccgcccatattaaagcggagcttactcaattggatggacggatcatcgaatcgaaacagcttggcgggcaagtgctgcatcatgccgaaagcatcagcgccgtcgttcaggaaacggctgcaggaagcgaagagatttctgcctccgcgcttgagcagctgtcttcttttcataaaatggcggaaagcgtcaataatctggtgagcctgacagagcggttaaacgatcaggtccgccggtttactttgtaacgggcttttgccccgcccctgatttttgcagcctgacatgagtaacttctgaatgaaacacaaatactgaatatacatgtgtttatatttattctttttcgtgaaaggtgaaaaaagaagggaggaatcgggatggatgaacaaattccgcatgaaaagggtcttgataatagtctggctttattacgcgatggttatgtatttgtgaaaaaacgagcggagacttatcgctcagatgtgtttcgcgcccgtttattagggaagacattcatttgtatgagcggagcggaagccgcaaagcttttttatgacacagaacgatttcagcggcagcaggccctccccaaacgggtgcagaaaacgttattcggaacaggggcaatccaggcaatggacggtgaacggcataagcacaggaagcttctatttatgtcgctgatgacgccgccccggcaaaaacggcttgcggaagcggtggcaaaacagtggaaagcatctgcggaaatgtgggaggattcaaaccgaattgtcctttttgatgaagcgaagaaagtgctgtgccgggctgcctgtgagtgggccggcgtcccgctgaaagactcagaagtgaaagagcgggcggaggatttcaccgatatggtagacgcattcggcgctgtcggaccgcgtcattggaaaggcagaagggcgaggctgaaaacggagaaatggatagaggaggtcattgaggatgtgcggtccggcaagctgcaaacgccggagggctcagccttgtatgaaatggcttttcatacagaacttgacgggaacagacttgattctcacatggctgctgttgagcttattaatgttctgcgcccgattgccgccatttcttacttcattacgttttcagctcttgcattgcatgattaccctgaatatcggggcaaactgagatcgagagatgatcaggaggccgaaagatttgcacatgaagttcggcggtattacccgtttgccccgtttttaggagccgttgtgaaaaaagatttcgtatggaagaactgtgagtttaaaaagggtgcttccgtcatgcttgacctatatgggacaaaccatgattcccggctttgggagaatccgaatgaatttcgcccggaacgttttcaggggcgggaggaaaataaatttgatttcattccccagggcggaggtgatccggctaacggccaccgctgtccgggtgagggaatgaccgtggaagtcatgaaaacttcccttgcgtttcttgccaatgaaatagagtacgatgttccctcccaagatttaagcttcagcctgtccagaatgccggcattgcctgaaagcggattcgtgataagtgatgttagacgcatatagaacaaaaaacagccctctttcttctaagacaagagggctgttttgcttttacagatggtccggttttttggaattctggttttttcccgcctgccggtttttttcggcaagccggttctttttctgatttacggcgttattgtccaacggttttttgtcatcatctttcatgcggcaaagcctcccttctgtccgttaggatgcccgcccgcattgaaattatggcttcaggaaaaaaatcgcgagcgtgcccggcccggagtgggcgccgatcgcagagccgattgaatgaagaatgatctctttcggatggaacgcttcttcaatcatttctttcatccgaagcgccgtctcttcattatctgcatagctgatccccacggtttgatccgcccaatcgccgccttcttccttcatcatttctataatccgtttaaacagtttcttttgtccgcgcaatttttcgagcggcacgagcctgccgtcatccacatgcagaatcggtttgatgttcaaaagccccccgacaaaagcggacgtttttgaaattctgccgccccgcgcgagataagcgacatcatcgaccgtaaatatatgtttcatccgtgcgcaaaagctctttacagacgtttcgatttcttgtattgtattcccgttaacacagagtgtttgagcgtgcatcaccgcgaggccgcagcccaatgaagcgcatttggaatctacaatccgtaaatcaaaatcgggaaattcctcttttacttcattggcgatcattacggccgtctgataggtgccggaaagacctgaggaaaaggcgacgtatatcgccggttctcccagttccgcgtattgtaaaaatactttttttatcgtatccggtgatgcctgggatgttttcggaactttcccgtcccgcatcgcttgaaatatatgatccgcctgaatggtgaccgtgtcctcatattcgtttccgtcaagtgttacgtgcagcggaatgaacccgatccggttttcttcaatataagatttcggcaggtcagaggcgctgtcagcaataaggtgaactgtcatcataattcccttctttccgattggtgagagtgatgccaactatatcatataaatgtggcaaaatagtgttcaaaactttgttttaagggaaaagctaataatgaaaatgagcggaggagcaagccatggtactagaacaagcaaaaaaattagcaatcgtcgtcatcggcgcgtttctgtatgcggcgggactgaatttattcctgataccggcgaatgtatatgccagcggttttaccggtgtcgcccagctgctgtcaagcgtcgttgatcaatacgcccccttttatatttcgacaggagttctcatgttcctcttaaacattcccatcggtgtgttagggtggctgaaagtcggcagatcattcaccgtatacagcatattaagcgtagcgatgacgtccgtctttatgggaattctcccggaaatgagactgtcgcacgatattcttctgaataccgtattcggaggagtcatctcagctatcggcatcggtttaacgctgaaattcggcgcttcgacaggcggacttgatatcgtgtcgatggtgctggccaaatggaaggataaaccggtcggcacatatttcttcattttgaacgggattatcattttgacggcaggattattgcaaggatgggagaaagcattatatacccttgtcgctctgtatgtcacaacaagggtgattgacgccattcacacccgccacatgaaactgaccgccatgatcgttacgaaaaaagccgatgaaatcaaagaagcgatttacgggaaaatggtccgcggcattacgacggtgccggcaaaaggcgcttacacaaacgaacagaaagaaatgatgatcatcgtcatcacgcggtacgaattgtatgaccttgagaaaatcgtgaaagaagtcgacccgaaagccttcacaaacatcgtgcaaacgacggggatctttggtttcttcagaaaagactgataggagcggatagaatgaagtggctgtttggcctgttattaccggtcattttattgatcggatggagcagtcaatccgggcagaaggagcccgctgaggaggtatccggagagatgaatgaacagcaagcggaattagccgtaaaccctgtgcagacggatcagcagatcgaatttcaaatgtctttaaaaaacaaaagcggcagcccgatcgatttcacattcagctctgggcagaaattcgaattgaccgtacatgaccaacatcacaaagaactgtaccgctattcaaaagacaaaatgtttactcaggcgtttcaaaccgtgactttaatgccgaatgaaacgtatgacttttcagatgtgtggaaaaacgtgcccggtccgggaacatacacggtgacggtgacgtttttagggaagtccgatcagatcggaaaaagactgaaaacggtaaaaacatttgaagtgaaataaaaaagcggcgccctcgtctaaacggggcgcctttttttattgcaatttctccagctgatcctgaaattggtgcagctgctgacgttctgcatccgtcgaattggcgtacgcggaagacacggcgtttttggcgcgtgagacagctttttcctgatcgccgtcctcgaaaccgttagcaatcatgacggcctgctggacaaatgacttggcttgagaaaacagttcgtttctcattaaaagtcaacctgcctttcagccgaatcttttgctgcatcatgctgtgcttcctctaatgtagaccgatatggaaatcttgcgtcatgaagactgacagagtccttgccttgctgaataaaccgttttgatttgtttcgtttacccattgcaatgtcccccttccatatttagacgagatgagtcgtctgttttagtatgggcggaaggctttgtgttatgagcggcaaaacctcacagggagaaataggattttaaaaattcggcgattccgtccgcttcatttgatcccgtgacgcggtcggcggcctgtttgacttcatccgtgccatttcccatcgctacgccgcacccggcaaatcggagcatttcaagatcgttgtcttcgtcgccgaacgcgatgatccgttctctcggcacttggtaatagtcgctgattttcttcaggccgaccgctttattcatcccgtgtttaataatttcaatcacatgccaaggagccgcccatcttctgtggtcaatgacctcggcgtgcacatcggataaatgcgcgcgtatgtccgcgacgtcctcttcctttgcatgtatcaatacggacgtcacatcttcttggactgtttcgcgcagatcgccgaatgtgacattcgccgtattcatatgaaacgcctcaattaaatgctcatcatgataatggaagtacacatcatcaatgatctcagcgagcacattatgtatttgataggtctctgtaagttcggcaagctgtctgaccacatcgacagataaggacgtgtggtatcgtccccatgactcgtctttcgggtggtggacaaatgccccgttaaaattgacaatcggcgttgtcagcccgagctcgtcataatacatcgaactggaacggaaagggcggccggttgagatgcagacatgatgacccgcttctttcagcgtctgaatcgtccgcgccgtttcaggggaaatggttttatcatcttttaataaggttccatccagatctaaagcgatgaggtaaggttttgtctccataaataactccttttgtcatgtaatttgctgtttttctcttatatacagtgtagctttttaccatctttattgtctacatgttacacttatgattatggttatcctaaggagggagtcaacgtgattcttattgatcatcaaaccgtatcaggcattccgtttttacatattgtaaaagaagaaaatcgggaccgtcccgctccccttgttttctttattcacggttttacaagcgcgaaggagcataatcttcatttcgcttacctgcttgctgaaaagggcttcagggcggtgctgccggaagctctttaccacggtgaacgcgctgaacagttgtcagcagaagagctcgccgtccatttttgggacattgtattaaatgaaatcgaggagcttgacgtgctgaaaaaggattttgaagcgcgcggtctgattgaagacgggcggatcggtcttgcgggcacgtcaatgggcggaattacgacattcggcgcgatggccgcgtatgattgggtcaaagccggcgtcagtctgatgggaagcccgaactatacggcgttttttcagcagcagattgaccacattcaaaagcaggacatcgacattgacgtcacaaaagaacaggtcaatgaactgtttgcgcggctcaaaccgttcgatctcagtctggaaccggaaaaactccggagccgcccgctgctgttctggcacggcgttcaagacaaagtcgttccgtatgcaccgacccgcggcttttatgaaacgattaaacctcattacagcagccggcctgaccatcttcagtttctgaaagacgaacgggctgaccataaagtcccgagatacgccgttttagaaaccgtcgcctggttcgataagcatttataaagcacaaaggtgttaacaaaacccgcttttacgttatactgaggaaaaaggagtgatggaacgtggaagaagcattaaaagaaaacatcatgggcgccttggagcaggttgttgaccctgagctcggcgtcgatatcgtcaatctcggccttgtatacgacgttgatatggatgacgacggcctgacgcacgttacgatgacactgacatcaatggggtgcccgctcgctccgatcatcgtcgacgaggtgaaaaaagcgctcgccgacattccggatgtaaaagagacggaggtccacatcgtctggaatccgccgtggacaagagacaaaatgtcacgctacgcaaaaatcgcattagggattcagtaataagaaaatgcacctcggattttaggtacatcctaaagtttggaggtgcttttcttttgtctgcatataagcgacagtgagggtttgttttggatcgcaaacaaacctttatatataaaatttcatatgaggtttatcttttttgtaataggacagtctgtcttggagtgtgcctgtgtggaattcaaatttatgtccatcaggatcagtaaaataaattgacttttgatcttgtttatctctaggacgcccatttaatatatttacatttagattttttagccgttgatgtattgcatcaaaatcttttgggtcaattgtaaaggccatatgcgtataagatttatgtatttcatttcttggtatatccgcctctaagttaagtgcaagccaaagcccgttcagatcaaaatatgctgttttttgccctttaaccaggagttgtgcatgaaatactttttcataaaattctatagatttttccaaatttgaaacagaaaaaagaagatgattgattccttttatgtttattttccccacctcatttaacatgtttgtcttaaacaatccctttggtaatacatctgcatatatatcgattatatactgactaaaaaatcattttaaggatttctgtgtattttttatgtcgtgtgttttccggtatcgggttaaaaaggaaaaaaacggacgtaaggcatgatataatagaccggctgcatgcgagggaggaacccatgaagaaaaaattacttctcattatccttagcattcttgtttatacggcgctgttcgctgtttccgcttttcacaaagagccggagcagcaggcagggacaatgacggatgtcagccgtctcatgcccgtgaaaattaagcagacggtcaaaggaaaagagaaagaaacattgatcgaaaccattaaggaagcaaagagaaagcatctgaagatctcaatcgcaggcgcccagcactcaatgggcggccagacgtattatgaagacggtatcgttctcgacatgacgggctacaacaaaatactcggtctcgaccgaaagaaaaaaatcatcagagtgcaggcgggagcgacgtggaatgatattcagcgctatgtcaatccgtacgggctcgcggtaaaagtcatgcaatcgcaaaacatttttacgatcggcggctcactgagcgccaacgcccacggccgggatatccggtacggttcgctgattgatacggtcaaatcgtttcatcttttaaaggcggacggcacaatcatcaccgttactccgaaagatgacctgttttcagccgtcatcggcggctacggcctgttcggcgtcatccttgacgcggatattgagctgacggatgatgaactttatgaaatgaaaacgaaacgcatgaacgctgatacatacagtcaatattttacgcagcatgttcagcgcaaccccgccgtgcgcatgcatctcgcgcggatcgcaacaggggataaaggctttttgcatgacatgtatgtgactgattacacgctctcagacaatcagaaagaattaaagcagcacaatgaactgaaagaagatgagcatccggcgctgacgaaattcgcgcttggcctctcccgccggtatgactggggcagaaattggttctggtcaacccagcagtcttattttctcagccaaaacggcgtgaaagtctccaggaacaatgtcatgcggtcagagtcgaaatttttggaatatgaaaacacggacaacaccgacgtgctacaagaatacttcgtgcccgtcggcgaattttcgccgtacattcatgatttacgcaagacgctgtcacatgaagatttcaatctcgtaaatattacgatccgctacgtgcaaaaaaatgaaaaagccgatctgtcatacgcaaaggaagacatgttttcactcgttcttttaatcaatgaagggttttcaaaagacagccaggcgagtgcggtgcggattgtcagaaaaatgacggatacggcactgcgccaccgcggcagttattatctcccgtatatgctgtaccaaacgaaagagcagatgcgcgaggcatatccgaaaagcgatatgttctttcagaaaaaacacaaatatgatccggatgacttgtttatgaattatttttatcagaggtacaaatcatgaaacacaaccatttaaaatggctgatcctgtctcagagcagtgtcttttttgccggcagcctgatctttccgttttatattttatttattaaaaacatcggttccagctacacgcaattcggtctctcatacggcttgttcggcctgagcggcgcattgattcatccgctgctcggccggctgtcggcaagactggacccccgctggttccttatggcaaattcgtgggggatggcggtgcttcttctgacgctcccgcacattaccggcgtgcaccaggtttatgttgtgcaggtgcttttgggcctgttcggcgcgatgcaaaaacacggcgagaaaatcatgatcgccgattacaccgacggcggggagcggggaaaaaaagtcggcagctatcatttctggacggccgtattttcagctgccgccattattctcggcgggtttctcgctgatttctttacggtttatattattttttacgccagctccgtgctgttttttataagcgggctgatgatgctgaagaaaacaggctgatccgatcagcctgtttttcttatggaactccctcgaacgagaggggtttttttgtcagcgaaaacagatggaaaatgaatgaaaaaatattaaatatacaattgaattaatttttattcatgttataatgttaaataatttcacaaaaaccaagaaggtgaacccgttgaaaataggtattataggcgctactggttatggaggcgccgaacttgtcaggattcttaaccatcacccttatgcagaggattgtatattatattcatcgagcgacgaaggaaaagaatatgccgcttcatatccgcatttgaggaatatagcgtcacaatcacttcagccgcttcacatagaaacgatccgaaacgaaattgatgtcatgttcatagccgcgccgcccggcgtctccggagagtggtcgcccaagctggcggaggcgggcatcccggtcattgatctatccggcgatctgcggattcaaaacccggccgtgtatgaaaagtggtataagcggaaggccgctccggaagaaacgattcaaaacgcggtttacggtttagctgaactgcaaaaagaagagattcagactgcaaagctgattgccaatccgggatgttttccgacggctgtgctgctcgggctcgccccgctggcgaagaataagcttttacaagattcatttctgattgttgatgcgaaaacaggcgtatccggcgccggccgaaaagcatccatgggcactcattattctgagctgaatgataatttcaaaatttataaggttaatgagcatcagcatactccggaaattgaacagcaattagcggcttggcagcccggcacaggcccgatcacgttttccgctcatttggcgccgatgacaaggggcattatggcgacgatgtatacggaggctcccccgggtatgtctgctgcacaggtaagagaattgtattccgaattctacaaagattcatattttgtcagaatcaggccggaaggtgaatttccggcgacgaaagaggtatacggcagcaatttttgtgatatcagtgtcactgtggacgaaagaacaaaccgtgtcaccatcgtttctgtcatagataatctgatgaaaggcgccgcagggcaggcggttcaaaatttaaatatcatgaatggctggcaggaagaaacgggacttacgatgacgccagtctatccatagaacgaaagagggattcaaaaatatgattcagctgagtgaggaaatcacgaaaataaaaggcggcgtatcctcgccgaaagggtttgaggcaaagggcgtgcactgcggtctgcgctattcaaaaaaagatctcggagcgattatcagtgaagcgcctgcagtcagtgcagcggtatatacgcagagccattttcaggcagcgccgctgaaagtgacgcaagccagcttgaaaaaagagggtgtgcttcaggcggttatcgtcaacagcgcaattgccaacgcctgtacgggagaccaaggattaaaggacgcctatgaaatgcgggacggcttcgcgagccagctcggcattgagccggagcttgttgcggtttcgtcaaccggggtgatcggcgagcttttagatatgaaaaaaattcaagcgggcattgaacagctcggtcaagcgccgtccgtgtccggagcatttgaagaagccattttgacgacggatacagtgacgaaacagacgtgttatgaactggtgatcggcggagacatcatcacgatcggcggagcggcgaaaggctccggcatgatccaccccaacatggcgacaatgctcggctttgtcacaacggacgcggccgtggaagaacaggcgctcaaaaacgcgctcagagagattacggatgtttcatttaaccaaatcaccgttgacggagaaacatcgacgaatgacatggtgcttgtgatggcgaacggctgcgcggggaatgattgcctgacggagcagcaccctgactggccggcttttaaaaagggattaaagcttgtatgcgaagaccttgccaaagatattgccagagacggtgaaggagcgacgaaattaattgaagccagagtcgaaggcgcgaaaaataaccttgaggcgaatattattgccaaaaaaatcgtcggctcaagccttgtgaagaccgccgtttacggcacagacgccaattgggggcgcatcatcggcgcaatcgggcacagtgcggcaagcgtaacggccgaacaagtggaagttttcctcggcggccagtgtctgtttaaaaacaacgaacctcagccgttttcggaaactgatgccaaggagtacttatcaggtgatgagattacgattgcagtccgcctgcaggaaggctccggcagcggccgggcatggggctgtgacttaacctatgattatatcaaaatcaatgcgagctatcgcacataacaaaggggagcggcatgaagaaaaccatcgtttttaagtgcggcggaagcgtgatccgcgagttatccgccgatttttttcaaaatgtaaaagagcttatgcaatcgggctggaacattgccgtcgtgcatggcggcggcccggacatttcaagaatgctgaaaacattgcagattgaaacggaatttgtcgatggacagcggaaaacgaccaaaccggtgctggaaacagcggaaatggtcttgtcagggacgatcaataaatttttcgtaatcgaactcgcgaaaaacgggctgaaagccgcgggaatatcaggtaaggacggcggtctccttcaagcatcctatcttaatcaagacaaatacggagaagtcggcgaaatacaaaaaaccgatcggtcaatcatccaagcgttaatgaaagcaggcatcattcccgttatcgctccgctttccatgacaagtgatttcgaaacgctgaacgtcaacgcagacgccgcggcatcggccgttgcttcagccttacacgccgataaacttttatttgtcacggatgtcgaaggaattatggacggagagaacaggctggatactttgacgccgcaagagattcaggccctcatagatgacggcgtgatttcaggagggatgattccgaaagtaaactcggcattatcggcactgagtgaagatgtcgaggaagtgatgatcgtaaacggaaaaggagcgtttttcaccgatcaagccttccaaggaacaaaaatcgtcaaagaaaaggagagcgtgtcatgagcagtctatttcaaacctacagccgctggcccatcgatatcaaaaaagcgaaagggacaatcgcagaggatgaaaacggaaaaacgtatcttgattttattcagggcatcgccgtttccaatctcggccattgtcatgatgcggtgacagaagcggtgaaagaacagcttgacagcgtatggcacgtttccaatctgtttgaaaatgatcttcaggaaaaagccgcggcaaagcttgccgaacatagcgcgggggatctcgttttcttctgcaacagcggggccgaagcgaatgaaggcgccattaagcttgcccgtaaagcaacgggaaagacaaaaatcgtaacatttcatcaatcctttcacggacggacctatgcggggatggccgccaccggacaagacaaaatcaagatcggtttcggaccgatgcttcaaggctttcactatcttccgttcaatgatccgtcggcattcagcacgctttcaaaagaggatgatatcgccgccgtcatgcttgagacggtgcagggagaagggggagtcaatcccgccgatccggaattcatcgaagccttacagacattttgcaaagacaaacaggcgctgcttatcgcagacgagattcaaaccggaatcggccggacgggcaaggcattcggctatgagcatttcggcatctctccggacatcatcactgctgcgaaagggcttggaaacggttttcccgtcggagccgtgatcggcaaacagaagcttggagacgtctttacgccgggtacgcatggtacgactttcggcggcaataagctcgccatggcagctgtgaaagcaaccttggacattgtgtttcagccggactttctccaggcggcggcagacaaaggctcttttttaaaagcgcagctgaaccgtgaactgacagggccttttgtaaaagaaatccgcggaaaagggttattaatcggcattgaatgcgcaggtcccgtgtccggcattatcggagatttgcaggaacgcggacttctcgtgcttccggccggaccgaatgtcattaggctgctgccgccgcttacagtttctgaagaagaaatgctgtcggccgtcagtatgctgaaagcagcgatcgaagcgcattcggcagtgaaacggtaatttttttttcgatataagagtataaaaattcatatttttaattaattattcatcaagaggtgggctttagatgaaaggctatttagtattggaagacggaacatcattcggcggtgaacttgaaaaagaggcccgctgtgttggcgaagcggtttttttcaccggaatgacgggttatcaggaagtgcttacagacccgtcatataagggccagatcatcgtctttacgtatccgctgatcggaaactacggaattaatgaaaaagaccttgaaagtaagattcctcaagtcaaggctgttgccgtctatgaagcgtgtgaacatttttctcaccatgaagcagtttcaagcttgagagagtatttaaataaatggaacatcccgctcttaaccgaagtggacacacgggccgtcgtcaaaaccatccgctccggcggcacgatgaacgctgccgtgtcaacaacaggagagattcccgcagcatccggaacagaaaacccggcggagctggcgcagtctgaagacatcacgtcaatggggaacggagaccggcatattgcgctgattgatttcggttataaaaaatcaatcgcctcgtcacttgtaaagcgcggctgtaaagtaacggtcattccgtatcagcagatgaacgctgtttatgacattcagcctgacggaatcgtgctttcaaacggcccgggcgacccgaaagcgattgcgccgtacatgaaccggattacatcattactcagtgatttccccgcactcggcatttgcctcgggcatcagctgattgccctggctttcggaggaaatacgtataagctgccgttcggccacaggggtgccaatcatcccgtcattgaccggaaaacgaaacgggtgtttatgacaagccagaaccacagctatgtcgttgatgaagcatcaattgacgagaacgagctgtccatcagatttcatcatgtcaatgatacatcagtggaagggctcattcataagcgccttcccgtattaagcgtccagttccaccctgaagctcaccccggaccggctgagagcgagtggatatttgatgaatttctagagaaagtgataccagcaaggagagaaatcgctcatgcctaaagatacaaccatttccagcatattagtcatcggctccggccccatcatcatcggccaggcggcagaatttgattattcaggaacgcagggctgcatggctctgaaagaagaaggataccgcgttattctagtcaacaacaacccggcaacgattatgacggatgaggcgtttgccgatgaaatatattttgaaccgctcacaaccgacagcatcgaggccattattgaaaaagaaaaaccggacggtctgcttgccaatttggggggccagacggcattgaatttagccgttaagcttgaagaagcaggcgtgctgaagaagcatcacgtcaagcttttgggaacatcggtggaaaccattcaaaaaggcgaagaccgggagcagttccgcgccctgatgaaagagctcgatcagcccgttccggaaagcgaaatcgtcgacaacgaagaagacgccctccgtttcgctgagtctatcggatttccggtcattctgagaccggcgtacacgttaggcggaaagggaggcggaatcgcgaaaacgaaagaagcatttcagacgcttattaaacaggcgctgttagcaagcccgatcagccaatgcctcgtcgaaaaaagcatcgccggttttaaagaaatcgaatatgaggtcatgcgcgacagcaatcatacatgcatcaccgtctgcaatatggaaaacatcgatcccgtcggcgtgcatacaggagactccatcgtcgtcgcaccgtcccagacgttaacggatgaagaatatcagatgctgcgttcagcaagcctggcgattatttcggcgctggatgtggtcggcggctgcaacattcaatttgcgctggatccgttcagcaaacagtactatgtcattgaagtgaacccgcgtgtcagccgttcatcggccctcgcgtcaaaagcgaccggctacccgattgccaaaatggcggcgaaacttgccgtcggctatacgctcgacgaactgaaaaatccgctgacgggctctacttatgcaagctttgaaccggcgcttgattatgtcatcgtcaaattcccgcgctggccgtttgataagtttaaacatgccgatcgcacgctcggaacgaagatgaaagcgacgggagaggtcatggcgatcgaaagaaatatggaagcggccattcaaaaagcggcggcctcccttgagctgaaaacgatcggcacccgcctgcctgaactcggcggctgtacgatcaatcagctgtgggaattagcggtaacgccggatgaccggagatttttcgtcgtcatggaactgttaagccgcggtgaaacgatagaagacatccatgccaaaacgaaaattgacccgttttttctccatgtattccgaaatatcatcacattggaaaacaagctgatggaagaaggggatcatctgtctgtcccgcttttaaagcaggcgaaggtaaagggcttcacggatgtcatgatcgcatctctcacgggaaaaacggaagaagacatccgtgctctcagaaagaaaacaggcatcgtcccgtcgtttaaaatcgtagatacatgcgccgctgaatttgatgccaagacgaattatttctactccacctatctaggggaaagtgatggagatatcagccgaaaagagaaaaaacgcgccctcatcatcggctccggcccgatccgcatcggtcagggagtggaatttgattacagcgccgtccacggcgttctgaccctgcaaaagctggggtatgaaacgattatgatcaataacaatccggaaacagtaagcacggattatgaaatcgccgaccggctttattttgaaccgctgacgacagaacatattttgaacgtggcggaacatgaaaacattgattttgccatcgtccaatttggggggcagaccgcgatcaatgccgctgaaccgctggaaaaagcgggcattccgctgctcggaacatcctttgaaacccttgatgcgctggaggatcgggatctgttttatcagctgcttgatgatcttgacctgaaacatgccaaaggcgaaaccgcttattcaaaagaagaagcaacagaaaaagcaagccgaatcggctaccccgtgctgatccgtccgtcttatgtcatcggtgggatgggcatgatcatcgttgattcagaagcgcaaatgtcagaactgctggaaaatgaagcgggcatgccgtatccgattttgatcgatcagtacattacaggaaaagaattggagatcgatctgatttccgacggacatgaagtattcgtgccgacttatacagagcacattgaacgcgccggcgtccattcgggcgacagttttgcgattcttccgggtccgtctgtcacacctgatatgcagcgtaatataaaagaggccgccgaaaaaatcgcggtaaaactggcttttaaaggcatcatgaacattcagtttgtcattgatgacaaaggagatattctcgttcttgaagtgaatccgcgggcaagccgcacggttcctgtcgtgtctaaggtgatgggggtgccgatgatcccgcttgccgccagattgctggccggcgcttcccttaaagacatcaagcccgaggttcaaaatcagcacggaacggcagtgaaattcccggttttttcttctcacgccattcaggatgtggacgtaaagcccgggccggaaatgaagtcgaccggagaaggcatgtgtgtcgcgtttgacgcagaaagcgccctgaaaaaaatctacgcgcacgtctgggagaaaaaaggcagcatctatctggaaggctgtgatgcggaattggaacgtcaggctcaagaggcgggatttacggtatgcaaagatgcgttcccggcatgggcagagcgaaaggataaagcggttcatatcaatttcaatcactctgaagaagcgcgtaaacaacggatcgaagccatgacgcacggtgtgacggtctttactgaaccggaaaccgtaaaggcatttttagaaagcggctccggcaaacctcagcctgtatcgctcaaagatctttatcaaaaggaagtggcatcatgcacacaataaaagcggaacacacattaacccatttgtacggaaaagattttctttccttaaaagatgtcagcccgtcagacatcaatgcgcttctgacagaagcttcattattaaaacaacatccgatacagccgattttccaagggaaaacattggcgatgatttttgaaaaatcttcaacccgcacacgtgtgtcttttgaagcgggaatggcccagctcgggggaacgggactatttctttcaagcagcgacctgcagcttgggcggggggagacggttgcggatacggcgaaggtgctgtccggcttcgttgatgccattatgatccgcacctttgaacatgaaaaagtcgaagagcttgctgagcatgcagatattcccgtcataaacgggttgaccgaccggtatcacccgtgtcaggcactcgcggatctgttaacgatacaagaaataaaaggaaaattaaaaggagtaaaagccgcctatatcggtgatggaaataatgtagcgcattcactaatgatcggctgcgcaaaaatgggctgtgacattgcggttgcttcgccgaaaggctatgaagttgaggaagaggcggtaaatgccgcaaaagaagcggcggctgtttccggagcgaaaatcacccttaccgaaaatccgcaggaagcggtgcaggatgcagacgtgatttactccgacgtcttcacgagtatggggcaggaggaagagacgcagcagcggctgaacgtgtttgctccgtatcaagtcaacgcctcactcgtcagtctcgccaaacctgactatacatttttgcattgcctgcccgcgcatcgggaggaagaggtcacgtccgagattatcgacggcccgaactctgcggtattccagcaggcggaaaaccggcttcacgcgcaaaaagcgctcctgaaagctcttctttacaaacaggatgaacaaaaaaaccgctgaatctcatcagcggtttttgatatttctccgcatacaagcgcatactacataaaaaagaaaaaggaggaaatgacgtgggacagcagcatcaattccgcccgggacaaaaagcgccgaataacggtgtgtacgttgaaatcggcgaaacgggaagcatggtcaaaaatccgcagaaaatcaagctcacagtgggagaaatgttccctgaaacttcaaaccacaacagattgtggacgtatcaacgaaaaccgtgaacacaaaaaaacctgctgaatagcaggtttttttatttaatgctggcttgcatcctgtttgacaggcatgatctccgcaagaacaaagactagcaccgcaataaccacggcaataacggatgattgcttgaaattgtacgccgcgctgttcatggaggcgaccaaataacaggccatatgtgttaaaaggaacgtccaaataaaaccgataataaaccgcacgtttccacctcgtccttcattttattctacgttgtatcataccatacataaagcgcgggcggaaggtcattttctcatcaaaaagcgcgcctgaacctgacatttgcccgcctgtcaggccgtctgaaggaaaattcggttcccgtgctcgggataatagccaaaacatagcagcaaataggagtttatccgatctgttttcattcttcttacatatgatagccaatagagagattaggagtaaaaggaggcgggcaggcatggggataacggaaagattcttccaattcggatctgagctgaacgtcatccatctgccgtatcggccgaacggcttctgtatctttattctgggggacagaacccactttgtcagccgggactcaagcttttggctcgaacatgaagggagaaaccagctgttaaatacgatgcttgacagagggtacaccattttcaacagcaatttatacggacggcattggggttcggaaaaagccgtcctttacgccagacagctgattcattatgtgctgaaacaagaaaccctcaatccgaaaatacacttgctcgcagaaggcatgggcgccctcatcgccgatcaattgctgcagtcttcaccggagcatatccgttcagccgcaatgttagatccttgtcttgatcttcaagcccattttgaatcagagaaagaaaataagtttttttataagcagtttctgagggaaacggcacaaagcttcggtgtttctgaaaaagaggcaagctcactgagctatcagaccattaccggctgccgcacccgcgcgccggtacatatatggcaaagaacgaccggagcgccgtacccgtacaccctgcatgcgaacgcgtataaagaagcccgggaaaagaccggaagcaagactgatatcacgtatcacctgcttgagaaccctgcgcgtatgtacagagccatctgccggtttttccgcagtcatgaaaaagacctgtaatgaatagaatacaacagccatctcttttcagagggctgtttggcttgtgtgtgaatgaaaaaccggaaaggcggcagatgtgatgaagacagcgctgatcattggagcagatgaatttctcggcctttcattgtgcgaacggttgatggatgagggtgtgcatgttgatgtcattttggcagaaccggaggacaaaacgaggcagctgtatttagaagaacgtttaatgtggctcgcgagaaacgggctttttcaaataatagatgaaatcggtgaaaaggaatacgatcgtatctgcgttcaatacgggagcgggtgtctgcctgaagaaagggctgagcctttatattggattgtttacagtgaggatcacggagactgggaaaaaaacggtcagcgggatacggcaaaagcgattatccttcctcccctctacggtccgtggacggaagcaaaagaagatggcgaaagcagggtctttttagaagacgcagtctgcgggctgatgaatcagcttgaggctgacggtacagaagacgaaaatcagattattaccctggaaataaaagaaaaaacacaaaaaacggaagcggaagaaaaaattaaagagtggaaaagacaattttcatcaatattcgacattttttaagaaataccttccatgttatgtgcattaccgctacaataaacgtatatcaatttatacatgttatgagtttgaaaaggggttgaacatggcttgatcaccaggcttgtcatgaccttttctgtcctccttttattgagcggatgcgcacaaactccgtttaaaggaaaaattgagaaggtcggaatgctttttcccgataccatcagtgacttggtatgggggacaaaaggttacaaaggtttattagcgatacaatctgaatttaacgttgacgtttattataaagaaaatatcagatccgatgaagatattttaaaagcgatagatgattttcataaaaaaggagtcaatcttttatacgggcacggaaatgaatacgaggaaattttcaatatgatcagcaaggattatcccgacatggaattcgtcgtcgcaaacggaacggcgaaaagcgataatgtcacaagcgttcatcttatgggagaagcaatgggctttttcgggggaatgacggccgcccatatgtcaaaaaacaatgaggtcggcgtcatcgcctcttttttgtggcagcctgaagtagacggctttatcaaaggagcgaaatatgaaaagcctgatatcaccgtcaatactgaatttacggaccactgggataacggcaatgaagcgctgcatctttacgagaagttaaaagcggaaggcacggatgttgtatatccggccggagacgggtataatgttcctgtcattcagcaaatcaaaaaagacgggctttacgccatcggctatgtcgccgagcaatcgaatctcggcaaaaacacggtgctgacaagcacggtgcaaaacgtagataaagcctatacattaattgccgagcaatataataaaggtacgctcaagagcggagatcacaactttgatttcagggaaggagtcgttgaaatggggacgttcagccctctggtggacaaagcatttcaagacaaaatctcagaccttgtcaaaacgtataacagaacaaatgaactgccgtcaaatgaatagaggtggatacacatgcagcatgaaaagtctcttgaatttatgcagatcgcgatgaaatacctgccggaagcaaaggcggagcttgagaaatccggcatagatctgtctatggaaatgattcagccgtttatggacctgtttacatcggtcatggcggaagcgtatgagcttggcagatctgatgccggggagctgaataaataaagagagccacttttcatgaagtggcttttcacatgatttttttctttatagcggacaccatcggcgcgaagtctttaaatacgggctttaattgatccagagagttcatgatggaccccagctgattcatcacgtggttgtaatcgatctcttcttcgttttcagcctgaggctgctccgggttttcttccggttctttatcccggtctctggaatcgccgaacatcattttggagaaaatatccatagtgaagcctcctttcgtcttccttttattctatgaggagcagcgtccgatagtttagacgaatatattgccaacagaaaaaaaatagggtagaattagtacctgatactaataattgatcataactaattagttttaaattcattataaaaaaggagtcttttccaatgaaagctggaattcttggcgtcggccgttacatcccggaaaaagtgctgacaaatcatgatcttgaacaaatggtagatacatcggacgagtggattcgtacgagaacaggtatagaagaaagaagaatcgccgcggaagatatgtattcatccggcatggccgctgaggctgcgcaaaaagcgcttgatcaggccggcatttccgctgaggagcttgatatgatcctcgtggcgacggttactcctgaccagtctttccctaccgtttcctgtatgatacaagagaagctcggggccaaaaaagcgtgcgcgatggatatcagcgccgcatgtgcgggttttatgtacggtatcgtaaccgccaaacaattcattgaatcgcaaacatacaaacatgtcctcgtggtcggcgtggaaaagctctcaagcattaccgactgggacgaccgcaatacggctgtgctgttcggagacggagccggagcggcggtcatcggaccggtcagcgacgacagaggcatactgtcatttgagctcggagcagacggtacaggcggtcagcacttgtacttagatgaaaaagggcatacaatcatgcatggaagagaagtattcaaattcgccgtccggcaaatgggtgaatcgagtgtaaatgtcattgaaaaagccggcctctccaaagaggacgtagactttttgattccgcatcaggcaaacatccgcatcatggaagcggcacgggaacgtttggagcttccggttgaaaagatgtctaaaacagtccataaatatggaaacacatccgcagcatccattccgatttcattagtagaggaactggaagcaggcaaaattaaagacggcgacgtcatcgtcatggtcggtttcggcggaggattgacatggggcgccatagcaatacgctggggacgataaaaaaaagtgaggtgcacacaagatgagtaaaaaaagagtagtcgttacagggcttggagccctgtctccgcttggcaacgacgccgaaacaagctggaaaaatgcaatcggcggcgtatccggaatcggaccgatcacacgtgtggaatcggacgagtatccggcgaaagtagctgctgaactgaaagatttcaatattgaaaattacatggataaaaaagaagcgcgaaaaatggaccgcttcacgcaatacgctgtcgtagccgcgaaaatggccgttcaagatgccggtctgaacatcacagacgagatcgcgccgagagtcggcgtttgggtcgggtccggaatcggcggtcttgaaacgcttgaatcccaattcgaaatcttcctgacaaaagggccgagacgggtcagccctttctttgttccgatgatgattcctgatatggcgacaggccaaatctcaatcgctctcggagcaaaaggagtcaactcctgtacggtgacggcatgtgcgacgggaacaaactctatcggtgacgcgtttaaagtcattcagcgcggcgatgccgatgcgatgattacgggcggaacggaagcgccgctgacaagaatgtcatttgcgggcttcagcgcaaacaaagccctttctacaaatcctgatccaaaaacggcaagccgcccgtttgataaaaaccgtgacggctttgtcatgggagaaggcgcggggatcgtcgtgcttgaagagcttgagcatgcccttgcccgcggtgcgaaaatctacggggaaattgtcggctacggctcaacgggtgatgcctatcacattaccgcgcctgcccaagacggggaaggcggtgcgagagcgatgcaggaagcaatcaaagatgcgggcatcaagcctgaagaaattgattacatcaacgctcacggcacaagcacgtactacaatgataaatatgagacaaaagccattaagaccgttttcggtgatcatgcgtacaagcttgccgtcagttcgacaaaatcaatgacgggtcatttgttaggcgctgccggaggaattgaagcaatcttctccgtcatggccattaaagacggcattatcccgccgacgattaacatcgaaacacctgatgaagagtgtgatttagattatgtaccggacaaagcgcgcgagcaggatgtcaacgtcgttctcagcaactcgctcggcttcggcggacataatgccactttgatctttaaaaaatatcaataatacagtttctgaccggctgcctgaaaaaggtggccggtttttttgtgcgtgcatatgataacaacaagaggaggcgaaccggtatgagcgtcaagcagacatatcaatggatggaaaaggcggcatccgtaaatgatctggccccgcatcttttgccgcttttttcaggggccgataagaaagagtggaagccgatactcggcatgctgcaaaaccacggcatgttccgccatttgaaggatggcgttaggaccagtaaacggctgaaagaaaaaggatgctacagccatattcaaaaggaggaagcctatttaaaggagaagtggaacgggccggacgtgccgatcgtagttttgcccgtcgatgaacgaaaccggaaaatccgtcaggaattcggatcaaaatccggtctggcctttcgggacaaaatgttcctctttctatcgtcggatagttccaattcagctgtatccgcccttatgacacatgaatataatcacgtctgccggttagaacatgtgacaaaggacgaaaaagatgagacatttcttgatacaatcatgatggaggggctggcagaatatgctgtatatgagcggttcggctcaagtcttacggcggaatggacgtcctactatacgcctgagcagcttgattttctgtttgaaaaaagagtcaagccgaacctccgcttaacgagagacagcagaatgttttcccagctgttatacggaaaaggatacttcccctcaatgctcggctatgccgtcggattcaatatagtaaaaaaatatttaaccgaccaccaacaaacagtaaaagaagcattggccattccttcaaaaacctttctggaggcaacgctttaatagattaaaagaatggaaattatttaaggatattacatttatcctaaaaaattcttgcttttgtaataatgatgtaataatatacaactataaaatttttcgactattctatattttgtgatagcgaaacgtatgtttccctctgcttcagcggaatgagaaaggggcgtatcatgagcacactattagaagtgaataatttaaagacctattttttcagaaagaaacagccgatccccgcagtcgacggggttgattttcacattaacaaaggcgaaaccgtcgctcttgtaggagaatccggctcgggcaaaagcatcacctcgctttctattatgggacttgtccaaggctcgggcggaaaaattatggacggctcgattaagcttgaaggcagagacctggcctccttcaccgaaaacgaatattgcaaaatccgcggaaatgacgtctctatgatctttcaggagcccatgacttccctgaatccggtgctgactatcggcgaacaaattaccgaagtgcttgaataccataaaaaaatgaataaaaaagaagcgtccaaaaaagccgttgagcttctggaactcgtcggattctccagagcggaacaagtgatgaaagaatatccgcaccgtctttccggagggatgagacagagggtgatgatcgccattgcgctcagctgcaatccgaagcttctgatcgctgatgagccgacgacggcgcttgatgtgacgatacaagcccaagtattggagctgatgaaagacctctgcaaaaaattcgatacttccattctgctgatcactcacgatttaggtgtggtttccgaagccgcagacagggtgatcgtgatgtactgcggacaagtcgtagagagcgcgagtgtggaggacttatttttaaaccctcttcatccgtataccgaagggctgttaaactccataccggtgatagatggagggattgatacattaaaagcgatcaaaggcagtgtcccgacaccggataatcttccggaaggctgccgattcgccccgaggtgttcaaaagcgatggacaaatgcaaaacagggcagccggagctgataacgcatgaaagcggccgttctgtaagatgttttttatatgaggaagagggtgcccaatcaaaatgacagctgcaggccaagaaacgattttagagctgaaagacgtaaaaaaatatttcccgatccgctccggtttttttcaaaggaaagtcggtgatataaaggctgttgacggtgtttctttttcactgaagcgcggggagacgctcggcatcgtcggtgaatcaggatgcggcaaatcaacggcgggaaggacgatgatccgtttatacaagccgacagacggccggattctttttaaggggcaggatatttccggcttatctgaagaaaagctgagaaaaagcgtccgcaaaaacatccagatggtcttccaagatcccttcgcatcccttaacccgaggaaaacgctgcgttccattattaaagaaccgttccagactcaccatatgtacagcatgagcgagcggaacgagcgagtggaggagctgctggcgaaagtcggccttcatccgagctttgcaaaccgctatccgcacgaattttccggggggcagcgccagcggatcgggattgcgcgggctctgacattgaatcccgagctgattattgcggatgaacccgtttccgcgctcgatgtctccattcaggcccaggtcatcaatctgatggaagaactgcaggaagaattcaacctgacctatttgtttatttctcatgatttgagtgttgtccgccatatcagcgacagagtcggcgtcatgtatctgggaaaaatgatggagctgactgaaaaacacgagctgtacggcaatccgcttcacccttatacgcaggcgcttttgtcttcagtgcccgtcacgagaaaaaaagacgccgtcaagcgggaacgaatcatcctgaaaggagaactgccaagcccggcaaacccgccgaaaggctgcgtgttccacacgcggtgcccgatggccaaaccgatctgcaaggaacaaatcccggcatttgaagaagccgctcccggccattacgtcgcctgccatttatatgcctgaaatgacaagcatcgagagggggtatgccggattacataaccagtttgctgcatatatatcacaaagggggaattgatatgaaattacgtaaaagcgcactgatgatgctaagtgtttttatggcgctcgccatcttcctgtcagcctgctccggttcaaaatccacaagcaccgaatccaaaccggcaggaaaaccgcaaaaaggcggagatttggttgtcgggtcaaccggggaacccacactttttaatccactttattctaccgatgttgcaagttctgatattgaaggaatgctttacagcacattattggaaactgatgagaaattaaacgtcaagccgtcgctggctgaaaaagtaacagaagctgacgggggattaacgtatgatgtaaaactgaaaaaaggcgttaaattccatgatggaaaagagctgaccgccgatgatgttgttttcacctacagcatccctcttaacaaagattacaacggtgagcgtggctcgggttttgagtcccttaaatccgtaacgaaaaaaggaaaatatgaaattcagtttaaaatgaagaaaaaagatgcctatttctataatgtcgttctcgacagttacggcattttgcctaaacatatattgggtaaggtgccggttgcagatctgggagagaatgaatttaaccgtaaaaatccaatcggttccggtccgtttaagtttgttgagtggaaaaagggcgagtatgtcaaactggaagcaaatgatgattactttggcggcagaccttaccttgatacagtgacagtaaaaacaattcctgattctaacgcggccgtggcccagttaaaagcgggggacattgatttcttcgttgtgccgggcacagattttgatacggttaaaacgtttggaaacgtgaaggtcaaatctgaccttggcttaaactacagctatatcggctggaatgagaaaaaagagatctttaaggacaaaaaagtgcgtcaggcattgacttacgctcttgacaggcaggcaatggtggatcaagtgctgaacggagacggtaaggtagcggatgttcctgagagtccgctgtcatggaattatccgaagtctaaagtgccgacatttgattataatccgaaaaaagcaaagcagctgctaaaagaagccggatgggaagaccatgacggtgacggctaccttgataaagacgggaaaaaattctcatttgaaattaaaacgaatcaaggcaataaaattcgtgaagatttagctgttgtcgttcagcagcaattaaaagaagtgggaatcgaggctaaaccgcgaattgttgaattcagtgcgttaatcgaacagacaagtgcccctaattgggattatgacgctcttcttctcggatggagtcttgcaacgttcccggatcagttctctatcttccattcaagccaatcgaaaaacgggctgaataatatctggtataaaaacccgaaagtcgacaagctgcttgaagaagcgaagacaattacagacagaaaagaataccaaaagaaatatgaagagatatacaaattgattgctgaagatcagccgtacagcttcttattctattacaattaccacagagcgatgccgaataatttacaaggctatgtattccaccctaaaaatgacttgtacaatattgaaaaatggtggctggatcaaaaatagcaaaagccctggagagggaaggaggttcctttcctctcttatcctatttaaaaaggggacaagaacatggttacatatattttacggcgaacattaatgtccttgccgattctcttaggcattacaattttgtcgtttgccatcatgaaagcagcgccgggagacccgatgtcacttatgatggaccctacaatcagtcaagcggacagggcgaaattcattgaaaaatacgggttgaatgatccggaacctgttcaatatgtgaaatggctggggaatatgctgcaaggggatttcgggacttctatcgtcaagaaaggcactccagtttctgaacttatcttatcccgcttaccgaatacgattgtgcttatgcttttctcaacccttgtcgctcttcttatttctattccatttggtgttctgtcagcgaaacgtccttattcaaaattggattacgggataactgttacttcatttttagggcttgccataccgaatttttggttcggtttgattttaatcatggttttatctgtaaatctggggtggtttcccactggcggagtaagcactttaaatgctgactttaacatatttgaccgattgcatcacttgattctgcctgcttttgtgctcgccacggcagacatggcagggataacgagatacacaagatccagtatgctggatgtgttaaaacaggattatatacgaacggcgcgtgcgaaaggattccgagataataaagtgatttttaaacacggtttgagaaacggacttcttcctgtcatcactatttttggtctgatgataccgtcatttatcgggggagcggtagtggtagaacagattttcacttggccgggcctcggcaaattgtttattgattcagccttttcgcgggattatccggttatcatggccatgacggtcatttcagctgtattggttgtagtggggaatttaattgcggacatcttatatgcgctggttgatccccgcattgaatattaacaaagagaggtgagaggtcaaatgttacagcccaataccggcacaccccccaacgaagtaaaattaaaggaaaatattcaatccaaaccggaaacaatgacgaagatttttttcgaaaagttctttcaaaataaactagctgtaatcggagccgttatattaaccatcatcatcttgtcagccttattcgcttcggtaatcgctccttactctccggagagtcaatctcttgtcaatcgtttgaagccgccgagcttaaaacatctaatgggaactgataaattcggaagagacatctttacgagggttctgtacggggcgcgcgtctccttgcttgtcggattcgcttctgtgatcggcgcgattacaatcgggacagttgtcggagccgttgccggatattttaaagggattgtcgatgccgttctcatgagaaccgttgatatcgtattatccatacctgatatatttttgcttattacacttgttacgatttttcagcccggaatggataaattaattttaattttctcccttacaggctggacaacaacggcacgccttgtccggggggaatttttatcgcttcgttccagagagtttgtattagctgcaaagacgatcggtacaaaaaatcatcacatcatcttttctcatatattgccgaatgcgctcggaccgatcattgtctcagcgacattaaaggtgggaacggttattttggcggaatctacattaagttatctcggtttcgggattcagccgccgatcgcaagctggggcaatatgcttcaggatgcacagaactttacgattatgattcaggcttggtggtacccgttatttccgggactgttcattcttcttaccgtattgtgcttcaactttgtcggagacgggctgcgtgatgcgcttgatccgaaaaatgtgaaatgatctcccggacggaacgggagattttttttgttgcaatgcagtcggaaatccagctccgtattgcggaaatctcatattgaaatggaataatttatctatcccttgcctatactgtggacaacagtttttataaagtgaggggtcgaatatgttatttcttcatgatgtatgggtcaattggtttgaaggggaagaaaacggctacaatgtatgccattttcacgaatggcggaaggaagacacggttgagcttttggatcagacaccgctgctcagagtgccgtcggtattatttcattacatagaaaacgacttatcagagcttccgaaagaactgcttgaccaagtccaccaaaagtcatacgtgcgaaaaaatcatgagcggacaaagctggagtactgttttgtcgtgacagacgggatcggcatcattgccgtggatacgatcgggtataccattccggtcagaaagagccgcctgattccgaggcaggagcagcttgtttatgaaatggtaaaggatgtagaaccggaatcgtttcaatttgagccggcgcaattggagtcttcaaaggaatatcacattttgtcattggcgccggagcatgtcagagggctgacgagaaaagagcggcagatcaagcagctgatgtttatggcgctcgaccagctgaaagggctgaaaaaccgtgcggaaattgtgtattggtacacggaatggaatccgcatatgtatgagcagatcaaacggatgagctttgaagaaatttgggacatgctttacaatgaaacaattgaaggctggtcagataaacatcttgcgttctgtgaaaatttgattaaagggcagccgtttttcgaaaagctttgggaaatggagcaggaatcaaaagtgaactaaaaaagaggcggggattctcccgcctcttttctttatcttcttttccgtccgagacccatggcgttttccatttttttcaccattttgccggccgttttgtttgcgcgcgccgctccttcgtcgagaatgcggtcaagctcgtcgctctcaattaattcacggtagcgctcttggatcggtgtcaatgcgccgataacgacttcggctaaatcacttttgaattcaccgtaccctttgccttcatatttagcctctaaatcttcaattgatgtgtttcctaaaatagaatagatcgtcaaaagattagaaacgcccggtttgttttctttatcatactttacaatgccttcagaatcagtcacggcgctcttgattttcttttcgagctgcttcggctcatcaagcagcgtgatgtatgccttttggttcggatctgatttgctcatttttttgagcggatcagccagtgacatgatgcgcgcgcctgattcaggaattttcacctcaggaatcgtgaagatgtcattatattttttattgaagcgttccgccaggttgcgggtcagttcaaggtgctgtttttggtcttctccgaccggaacaagatccgttccgtacagtaaaatatcgccggccatcagcggcggataggttaacagtcctgacacgacggcttctttgccctttgacttatctttgaattgcgtcatccgctcaagctcgccgatatatgcgacgcattggagcatccaccccgcctgggcatgagcgggaacctccgactggataaagagggtcgctttctcaggatcaagtccgacggccaggtaaagggccgcgagattgcgaatgttcttccgcagttcaagccgatcctgcggaaccgtaatcgcatgctgatcgacaatgcagaagtagccgttgtagtcatgctgcaaatcgacaaattgcttcattgcgccgatatagttgccgagggtaacggaaccgctcggctgaatgcctgaaaaaatcgttttcttcatatttcttacctcatttcttaaaacataataaaaaaagcccattcttcccgtagaaaaaagggacgaatgaaccgtggtgccaccctgattattccattacaatggaatcgctcgagacgttggtaacggaggctgctccggctgggcctactaacgttcggtcagctgctcagaagtccattccacatcgcccgttacctgctcccagcaccgcagactctcttcaaacggataaaaatgtgtactactcttcatcatcgcaatcacaacaaatgtatttgattgatctattataaatcaattatagccaaatgtcatcagaggaatacaagattatttccagtttgctaaagggctgaaaatcctcaaaaagaactgaaaatgcttaaatgataacgtatatcaacatttcgtataacgaatattatatgtaaaaagcaatatgaactggaaattgcaataaaaaaatttagttaggtcatgctttaaactatagaagtgtatcacctttttgacagaaaaactgaccaaatttaaatattttaaattgagaaaatagtattgcaataaattattcatttcattataatgaacttgttcactctattgttacagcttctttacataaaataatcagaaaagacggaacacaattaaagtttagaaaaatattaagttattttgtctgatatttctgagtatttagtggtaaaggctgaaaaatttgattagggggttagtgcatgaaaaagcgttggtctattgtaggtttgatgcttatcttctcgcttgtattaagtgcgtgcggcggattcagcggcggatcaggcggcggtaaaaaagacaccaaaggacagacttcacttaatatcaatattaaaaccgagccgttctcactgcatcctggtttagcgaatgattccgtttcaggaggcgtaatccgccagacttttgaaggattgacacgcgtaaactccaaaggtgagcctgaagaaggaatggcatctaaaattgaaacaagcaaagacggaaagacctatacatttacgattcgtgacggtgcgaaatggtctaacggcgaccctgtgacggcgcaggattttgaatatgcgtggaaatgggcgcttgacccgaacaacgaatcacaatacgcttatcagctctactacatcaaaggcgctgaagctgccaatacaggaaaaggcaagcttgatgatgtaggcgtaaaagccgtaaatgacaaaacattaaaggttgaactgaataacccgacaccttatttcacgcaattaacttcattctatacgtatatgccggtcaacaagaaaatcgcggaaaaacataaaaactggaacacaaacgcaggcgaaaattacgtgtcaaacggcccgttcaaaatgacggcctggaaacacagcggttccatcacgctcgaaaagaacgatcaatattgggataaagactctgtgaaattgaagaaaatcaacatggtgatgattatcaataacaacaccgaactgaaaaaattccaagcgggtgagcttgactgggcagggatgccgctcggccagcttccgactgaatctctgccgacattgaaaaaagacggatctcttcacgttgaaccgatcgcaggcgtgtattggtacaaattcaacacagaagtgaaaccgctgaacaatgtgaacatccgtaaagcccttgcttatgcgatcgaccgctcgtccatcgtgaaaaatgtaacgcagggcgaacaaatcccggccatggctgcggtgccgccgtcaatgaagggattcgaggataacacaaaaggttatttcaaagacaatgacgtcaaatcagctaaagaattcttggataaaggactgaaggaattaggcgtcaagaatgcctctgacctcccggcgatcaaactgtccttcaatacggacgatgcgcatgcgaaaatggctcaggccgtacaggaaatgtggaaaaagaacttgggcgtcaaagttgagcttgataactccgaatggaatgtgtacatcgacaagctgcacagccaggattaccaaatcgcgcgtatgggctggctcgcagatttcaacgatgcgatcaacttccttgaaatgttccgagataaagaaggcggaaacaatgatacgggatgggaagatcctgagtttaaaaagctgctgaaccaatctcagcttgaaacggatccggataaacgtatcgaagagctgaaaaaagcagaaaagatctttattgacgcaatgccggtcgcgccagtttatttctatacagatccttgggtacaggataaaaacctcaaaaatgtgattttgacaggaacaggcgaagtttacttcagaaacgcttcttttgaataaaagacggttctgagaacaaaagacccaaggtatatggggaggatgtccccatatacctttcttactgattacgtataaaattgtaaaaaacatggaggtgttcaccttgctgaaatatatcggtaaacgattcatttacatgatcatcacattgtttgtgattgtgaccgccacattcttcttaatgcaggcagcgccgggcggaccattttccggcgaaagaaagctgccgcctgaaattgaggcaaacttaaacgaacactatggcctggacaagcctcttttcgttcaatatgccagctacttaaaatctgtggcgatgtgggacttcggaccttcttttaaatataaaggccaaagtgttaatgatttaatcaattcaggcttccccgtctctttcactctcggtgcagaagctattctcctcgctttagcgttcggtgtgcttttcggggtgcttgctgccctgtaccataataaatggcaggattataccattgcgattttaacgatctttgggatctcagttccgagctttatattggcgacgattttgcaatatattttctcaattaaattagaactgttcccggtcgcagggtgggaatcctgggcatacacctttctgccctctattgcgctcgcttccatgccgatggcgttcattgccagactctcccgttcaagcatgattgaagtgttaaacagcgattacatacggactgcaaaagctaaaggactttcccgtccgtcagtcaccgtgcgccatgcgttgcgaaacgcgcttttgccggtcgtgacatatatggggccgatggcggcatccattttaacgggaagtttcatcattgaatccattttcggaattcccggtttaggcgcgcattttgtaaacagcattacaaaccgtgattatacggtcattatgggagttaccgtgttcttcagcgtgctcctgcttttatgcgtattaattgtagacgtgctgtacggattaatcgatccgagaatcaagctttccaaagcaaagaaaggagcctagaccatgcagaacattcctaaaaacatgtttgaaccagcttcagctaatgccggcgatgccgaaaaaataaataaaaaaagcctttccctctggaaagacgccatgctccgcttccgcagcaataagcttgcgatggtcgggttcgtactgatcgttcttattattctgatggcgatttttgcgcctgtcttttcaaggtatgattatgccactaccaatctattaaatgcggataaagcgccgtcgaaagatcattggttcggcacggatgaccttggaagggatatattcgtccggacatgggtgggcgcgcggatttccatctttatcggtgtcgcagctgccgtgcttgatttattaatcggcgtaatctggggcagcatttccggattccgcggcggacgcacagatgaagtgatgatgcgcatcgccgacattctgtgggctgttccttcattattaatggttattttgctgatggttgttctgccgaaaggattgctgaccattatcgtcgccatgacgatcacgggctggatcaatatggcgagaatcgtccgcggacaggtgctgcaattaaagaatcaggagtatgtgcttgcttcacagacactcggcgccaaaaccggccggctattgtttaagcatatcgtcccgaacgcgatgggctctatcctcgtaacgatgacactgacggttccgacggcgatttttacagaagcgtttttaagttatttgggcctcggcgtacctgcgccgcttgcgagctggggaacgatggcctcagacggattgcctgcattaacctattacccttggcgtctgttcttccctgccggctttatctgcctggcgatgttcggctttaacgttgtcggcgacgggttaagagacgcgctggatcctaagttacgcaaataaggagtgatatgagtgacacgtttgctagaagtaaaagacttagccatttcatttaaaacatacggcggagaggtacaggcaatccgcggcgtgaatttccatttgaataaaggagagacgcttgcgatcgtgggggagtcgggttccggaaaaagtgtgacctcccaagcgattatgaagctgatcccgatgccgccgggctactttaaaagaggacagattctttttgacggacgcgatatcgtgccgatgtctgaaaaagaaatgcaggccatcagaggaaaggacatcggaatgattttccaagacccgatgacctctctgaacccgacgatgagagtcggcaaacaaattacggaagtgcttttcaaacatgaaaaaatctcaagtgaagcggcgaaaaagcgcgccatagagctgcttgatctcgtcgggattccgatgcccgaaaaacggatcggccaattcccccatgaattttcaggcgggatgagacagcgtgtcgtcatcgcgatggcgcttgcggcaaatccgaaactgttaattgccgatgaaccgacaacagcgcttgatgtgacgattcaggcacagatccttgagctgatgaaagatctgcaaaagaaaattgatacgtctatcatttttatcacgcatgatcttggcgttgtcgccaatgtcgccgaccgggtcgccgtcatgtacgcaggtcaggtcgtcgaatcgggcacggtggatgaaatcttttatgatccgcgccatccgtatacgtgggggctgcttgcctcaatgcccagcctggacagcaccgatcaggaaaaactgacggccatcccgggcacgccgcctgatctgacgaatcctccgaaaggggatgcatttgcgctccgcagctcatatgcgatgaaaattgactttgaacaggaaccgccgatgtataaagtgtctgatacgcattttgtgaaatcgtggcttctgcatcctgatgcgcctaaggtcgagccccctgaagcggtgaaggctaaaatccgtcagcttccgaatacgtatcagcatcctgttttaatgaaggaaggtgaaaaaaatgactgagaaacttctcgaaatcaaacatttaaaacagcattttttcacgcagaaaggaacggtaaaagccgtagatgatttgtcatttgatatttataaaggcgaaacgctcggccttgtcggagaatcgggctgcggtaaatcaacgacgggccgcagcattatccggctgtatgaggcaaccggcggggaagttctctttaacggggaaaatgtccacgggaaaaaatcccgcaagaagctgctggagtttaaccggaaaatgcagatgattttccaggatccgtacgcatctttaaatccgagaatgacagtcgccgacattattgccgagggaatagatattcaccgcctggcaaaaacgaaaaaagagcggatgcagcgggttcacgaactgctggaaacggtcggtttaaataaagagcacgccaaccgctacccgcatgaattttcgggcggacagcgccagcgtatcggaatcgccagagcgctggcggttgatccggagtttattatcgcggacgaaccgatttcggcgcttgatgtctccattcaggcgcaagtcgtcaatttaatgaaagaattgcagaaagaaaaagggctcacttacctgtttatcgctcatgatttatcaatggtcaaatacatcagcgaccgcatcggcgtcatgtatttcggaaaattggtggagcttgcgccggcggatgagctttacgaaaacccgcttcatccatatacgaaatcattgctgtccgctatcccgctccctgatccggactatgaaagaaatcgcatgcgaaagaaatacgatccggcagttcatcagctccaagaaggagaaaaaatggaattcagagaagtgaaaccgggacattttgtcatgtgcacagaagctgaatttaaaacctatctataaaagtatcatcctccaagactcagtcttggaggatttttttgcgcacattcaagtttattaagcctgctcccgtttttctataatggaaaaaaagggggagatcagtatgaaaaccattttgtgcgccatttgtgcgggactgtttatcagtgcagccgcttatccggcccacgccgctgtgaaagaggagcagccgcttgtaaaaatagcgctggctgaaaaagaactgccgaaatcaaatgcacggttcgcttatccgtcagggctgcagtttacacatcctgataaggtgcggggcatttacgtcacagggcattcggcgggaggaagcaaattcggggagctgacagactttgtggacaaaacggagctcaatacaatggtgattgatgtcaaggacgacaacggaaacctcacctttaagccggacggccattctgagtatgccaaaatcgccaagccgtacatcaaagatccaaaaaagatgatgaaaaagctggaggaaaaaaagatctatccaatcgcgcgtattgtcgtatttaaagacagcgaactcgcgaacgaaaagccggagtggtcttttaaagaaaaaaacggaagtgtctggaaaaacggccgcggcgaatcgttcgtcaatccgtttatgaaagaagtatgggattacaatgtaaaggttgcaaaacaagccgtaaagatggggtttcaagaaattcagtttgattatgtccgttttcctgaaggatttgaaaaacgtgatgacgaactgacatacggacacggcgattacgggaaaacagcagacagcaatgtgcaaaaacgcgttcacgccgtcaccgattttgtcggttatgcgaagaaaaaactcaagccgtacggcgcggatgtgtcggttgatattttcggctattctgccacgctgccggaagcgccggggatcggccagaatttcagcaagatttcagaacaggtcgatgtcatttcatccatgatttatccgagccattggacaagctatttcggcattgataaaccggatcttgagccttacaatgtcgtcaaagaatacgcgaaggtggaaaataaaaaactgtctaagctgaaacacccgcctgtatcgcgtccgtggcttcaggacttcacggcatcatatctcggcagcggaaattatcaaaagtacggaaaacgccaggtggaagaccaggttaaagcgctgcatgaggaaggaattgacgaatttttattgtgggacgcggcaaaccgttataccaaaaacgtcgattacacaccattttaaaaaaattgaaaccatgttaaaggatcacacgtcttaatagatgtaagattgtttaaacaatcggaaatggggtatatctaaaagtgtgaagacaacgaacccataaggagcaaatgaatgaactggtacgaaaagctgagtgaatattttccgattgaagaaatgaaatcaaaagcgcatatggaagctctgttaaaggagcaaagcgatgtttatcataaagaagaggggcagtaccacgtgctgatgtatgcggaatttgactctttcatctttattgattacctgtttgtgtcaaagaaatccagaggacaaggcctcggaagcaagctgatcggcaggctgaaaaagaaaaacaagccgattctgcttgaggtggagcctgttgacgaggatgacacggatacacagaaacgcttgcgtttttatcaaagagagcatttcaagcacgcgcagtcaatcgggtatcggcgccggtcattggctacgaatgaagtgaacaaaatggagattctgtactggtcacctaagacggaatcagaagaagaaatgtttgaagcgatgaaacagacatatgaaaacattcacacttataaagatgaaaaatggtacggagaatcatacgaaaaaacggatgaagttctcaaagtcattgatgagaaaaaacgaaaaaacattttcgatcagctgagctaattgagaatggggaaaaatccgccagccgtaaatttgccggattgacacatttttttctcaggagactgttcacacttacttttttatagtataatacctataaagattccttttttaaagtcatttcaatttgagaatacaaacatgttcatcctactaattagaggagtgaagattaatggttacattatacacatcacctagctgtacgtcatgcagaaaagcaagagcttggcttgaagagcacgagattccgtttgtagagagaaacattttctccgagccgttatcaattgatgagatcaagcagattctgcgtatgactgaagacggtacggatgaaattatctctacccgttctaaagtattccagaaactgaacgtaaatgttgaatctatgccgcttcaagacttatatactttgatcaatgagcatccgggactgctccgccgtccgatcatcattgatgaaaaacgtctgcaagtcggctataacgaagatgaaatcagacgattcctgccaagaaaagtgcgttctttccaattaagagaagcacagcgtcttgccaactgatataagttacgataagcatggaaaaagcccaaaaccatcgcggtttgggcttttttatttttcagtctgctggtaaatcatactggcgaggataacaaatacgacggtcaaaatcggcagcatcatttgtataatgccgtgttctgccatgaaaaatgacagcttgctgtctccggcaatcatttcaccgccggtaaatgcgagaagaccgctcccggcgtacatcaataaaggcattttgtccatggcggcatgaacaagcttgctgccccaaatgataatcggcaccgagatgaagaggccgatcactacaagtgtcagctcaccgtgagaagcgccggctactgcgatgacattgtcaagcgacataaagatatcagccagaacgattgtgcggatggctttccaaagagaagaactgcttttcacatgctgcgcatctttcttctcaatcagaagctgatagccgagatacaataaaaataccccgcctgcgcattgtaaaaaaggaacattcaataaatagaccgcagcgctcgtcagaacgattctcaagacgactgcgataaacgttccgaagatgatcgcttgctgtctttgtttatgagccagattccggctggccatcgcgatgacgacggcattgtcgccgccgagaataaggtcaatcccgataataagcagaagggacagcaggtaatcgtgcggcatggtaacacctcgcttatagatcgattgcttgtacagctaatatatgaagcagtgcgctatttatgatgggaaccgggagaaagcctgtttttcggtgtgaaaatgcttttttatttcttttataactgttttatcataaaatagaaatataaagaatttgcgctgtcctctataaggttaagatgtggacggaatgggtaaagtgtagtaaagtactattcatcgggagcttagatgtcccttcaacatcttataaagaagggaaggttggcaaaatggaaatagaaagaattaatgagcatactgtaaaattttatatgtcttatggtgatattgaagatcgcggttttgacagagaagaaatctggtacaatcgcgagcgcagtgaagaactgttctgggaagtcatggatgaagtgcatgatgaagaagaattcgctgtcgagggtcctctttggattcaggttcaggcattggacaaaggactggaaataatcgtaacaaaagcccagctttccaaggacggacaaaaactcgaactgccgatcccggaagataaaaaacaagagccggcagatgaaaatctcgatgctttacttgatgatttccagaaagaagagcaggccgagagccgggaagataaggagcaaaagcttcagttcactttgcggttcgatgattttgaggatctcatctcgctatcaaaattgaatcttaacggaatcaaaacgaccctgtattcgtttgaagaccgatattatttatatgcagatttttatgagcaaactgatgaagaggttgaaaatcagctaagcatcctgttggagtacgcgcacgaatcatcagtcagcattcaccgtcttgaagaatacggcaaattggtgatcgctgatcatgcgttatatacaataaaaaaacactttgcatcataacaaaccgatttctctcagcagaaatcggttttttttgttctgaatgacaggatgaacggctgaaaaccgtataacggctctcatccgcaaacaggattatatcttcttcctgctgaatacaacaagattcaggaaaggagaagatgcaacatgttcagtgctgtgactgccgacggaaagctcattcagctggccggaagctattcaaaggaaaaagcggcggagctgagaaagaaacgctggttctgccctgtttgcaaaagtgagcttgatatcaaactgggacgggagaaactgccgcacttcgctcataaaaaaagcaggctgtgtccgggggaatccgaacccgaaagcgaataccatctggaaggaaaaaggcagctttttctctggctaaagacacaagggtgcagtgtcagcctggaaccgtatctgacttccgctggacagcggcctgacttgacggcggaaagcggagaagagaggctggcttttgaatttcaatgtgcgaacctttcggcggactctttaaagagccggacggcaggcctgaaaaacgccgggtaccggccggtctggattatcggggcaaaacggttaaaacggctggccgcgcaatttttccggctttctgcttttcactggcagttctttgaagtccattcattttcctccttactgttttactgccccgacgcccgctccttttacaggctgcattccatcactccgttttacaccggctattcttatgcctgcttaaccgcaatccctcttcacaaagcaaacctgaaagacatttgtcatccggaagggcggcacagcgtcagacttccctcgtggggacgtgccgtagccggcttccgcaacaaaagcgggcggtttttatctgaagatgccggtcttatccggcgtcttttttacgaaagacatcaggttgcatttccatttctcccctctgaagtgtttattcccgtttcagcgggctttgtgtttgcaagtcccgtttttgtgtggcagggccatttatacttgcggcttgcggaactttctaaaaaaggcgcgccgatccgattatccggcatggttcatgatttacggcaaaaaatcaggggtaaggagatccggatgaggtatggttcacaagacagccttatcggaatggcggtaaaacaatatgctgatttcttatgcttgcaggattttttaagggaaattgagaatgaagtatatatgccctcatctcaatggaagcgccctcaaacggcagaagagctgcgccggcgggatctgctcttttttggggaatgagaatgcttcatttcgttcaccctaacgtcaaggtggtggcgaatgtgaggggcgtacaagcattttgttttcgttttttcactgtattattggtatgctcggtcttatatgccgcatatgatttgacaaaaggcagtgaaaagccggaagataatcacaacacaagtttttggagaaacaatcgttttttcaattggcttgaagtaaagaaaacgagggggatcaccatgactgaggaaaataaagcagcacagctgcctgacagaagtgaagtaaaggcagagcatacatggagactagaggatatttttcctagtgatgaggcctggaataaagaatttcaagcagttaaagaattaatcccgaatttatcttcttttaaaggcacgcttgctcattcggctgataatttatacgcggcgcttacggcacaggatgaagtgacgaaccgccttgggaaactttatgcatacgcgcatatgcgctcagaccaggatacgggaaattctttctaccaagggctgaacgacaaagccgcaagcctgtattcccaggctgccagcgcgactgcttacattgaaccggaaattctggcgattcaggaggacaagctgcaccagttcattctggaaaaagaagagcttaagctttactcccatgcaattgaagaaattacaaaacagcgtccgcacgtgctgagcgaacaagaagaggccctgcttgcggaagcctcagaagcgctgtcgtcgccttccaatacattcagtgttttaaataacgccgatattacgtttccgtcgattaaagatgaaaacggcaaggaaactcaaatcacacacggcaactttattaatttcctggaaagcagcaatcgtgaagtccgcaaaaacgcatttgaagccgtatataaaacatacggacagtataaaaacacgatggcgactacactcagcggcactgtgaaaaaagataatttttacgcccgtgtgaaaaaatataaatcagcacgggaagcggctttatccaataacagcatccctgaagaagtttacgataacctgattaaaacgatcaataaacatcttccgttattacaccgttacattgacctgcggaaaaaggtgctcggccttgatgaagtccatatttatgacctttacacaccccttgtaaaagattcgggaatgaaggtcacatatgaggaagcgaaagattatatgctcaaaggacttgctccgctgggcgaggaatacgcgtctattttaaaagaaggacttgaaaaccgctgggtcgatgtatacgaaaataaaggaaaacgcagcggtgcttattcgtccggtacatacggcacgaatccgtacatcttgatgaactggcatgataatgttaataatctgtttacgctcgttcacgagttcggccattccgtgcacagctactatacgagaaaatatcagccgtatccgtacggtaactacagcatttttgtcgctgaagtcgcttcaacgaccaatgaagcgctgctcggtgaatatatgctgaacagcttaaaggatgaaaaacagcgtctgtacctgctcaaccatatgcttgaaggattcagaggcacagtgttcagacagacgatgttcgctgaatttgagcatctgattcatacgaaagcgcaggaaggcgagccgctgacgcctgaactgctgaacgaactttattatgatctgaataaaaagtatttcggtgacaacatggtgattgataaagaaatcagtctggaatggtcaagaattccgcatttctattacaattattatgtgtatcaatatgcgacaggctacagtgcggcccaagcgctgagcagccagatcttaaaagaaggcaagcctgcggtggagcgctataccgaattcttaaaagcgggaagctcggaatatccgattgacatactgaaaaaagcgggagtcgatatgacatcgcctgaaccgatcgaggcggcctgcaaaatgtttgaagagaaactgaatgaaatggaagaacttctttcgaaagtgaacccttcgtaattcaaaaaagcctgggcataagatgcgcaggcttttcctaaaaccctttaaacgtttttctatggttcagccggtacaaggcaaacaatatggacagaaacagcaggggagatgtaatgtaaatcggcagcatgtgcatcatggccagcaggtttaaaaagaagaaaaacacaatcattccgatgatcaatacgctgcggagcattgatttccctccttgtttttcattgatatattctatgaaaacaagcagtcagttatgttttgtgacaaaaatatgaacattaatcttatggcttgtcaaaactcgacaagatttgatatgataaggatgtgaaattgatcacaaacaaacattacccctttgtttgaccgtgaaaaatttctcccatcccctttgttgtcgttaagacatatgaaaccgcgcttatcccggcgcggtttctttatttgcacaaaaaaagccggctccgtaaggaatcagctttttttaatgatcacaacaggtgacatcctcctgggtgccggccagagatttccaaaacagaccgtgctttgcttccactctggcgacctttttggcgaatgccagttttttcatttctttttcaacttcttctagactcaaatcataaacgagtgcgatttctttcgatgcgacaaaccggaaatattcaatgaaacattccaaaggcggcgtttcagaaggcttcggttcatccccgagcatttcgaataagatctcttcgtatacgtcataagaatagttgccggggaccttcagcccttcatcatcatgcaggctgttaaagaacgtcaatgtcgggttgacggtgacgtccatttccgccgcgattttcatatcgcactgaagcgcttttaccgcgctttgcgaatggaggtcgcgcttgaattcttcaacatccaatttcgtcttttcggcaatttctaaaagaacgtcttcatctgtaatattctgcttggaaacaaacaggctttcctgcatgctgcggagaaacagaatgcccgcttttcttccctgcagttcagccgcttttaaagcaagtgcggcaaggtagggcgatgaaagaggctgatcctgctcaagccaaaggcttccgtcacagggcataccggaacggttcgcaattttttcccaagcttcggcaagaaggtgttttttccgtttttgcttattcaacgatgtaatgctcgcggaaacaatgatccgcagcgtaaaaaaacgtccgtatttgatttttaatttttttatggcgggctccagcgaccagcattcaggacataaagggtcgacaaacatgtaaatttcgagcggtttttttggatgtccgtggcaatgggcgaagtattgctcatgctgataattcgtcaatatgatcgatcctccgcttctgactggtttaccatatgcctggccgtcagttccagacgcccgtacagaaattcacgaatatcgccctccagcccgacctgatccatcgctttgctcatacagcttagccacgcatcagccctctcgtccgtaatcggaaaggggagatgccttgccttgagcatgggatgtccgtgctcttcagtataaagaggaggtccgcccaaatactgggttaaaaattgcttttgttttctggccgtttcagtcaaatcacttggaaatatcggcttcagcaagggatgagacgagacacgctcataaaaagtatcaacaagttgcgatagaagttcctctccaatcgcttcatatggtgcgttaaacgattgtcccatgttgactactcctttatatggctaataggaatcataattcccattgcgaatttatctttttgttttactatcttcagttactgtatattttagcaataacattttatttctacaaacaaagtgcctttctgtcaggcgcttgtatttcatatcatatcacatcgccttcattcatgtgtaagatttcactccgcaaaaaaaccagagggcgaaggaagcctctctggtttacgcgtaataatgtttggttatgtttttgacatactgctgtgtttccttaaacggcggaatgcctccgtaccgatctacgttgccggggcctgcgttgtaggcggctaacgcgagagatacatctccgtcgtatttcgtgagcatctgctttaagtacttcgtgccgccctcagcgttctggacgggatcaagcgggtttgacaccccgagtgattctgccgtggaaggcatgagctgcatcagtcccattgcccccgcaccgctgaccgctttcggattaaagcctgattcctgtttaataaccgcgcggatcagcttttcgtccacaccgtatttttcggccgctttctgaatggcgctgtctattgaaaagtttccggtgctgatgtcagaagccgcattcgcagactttatgcttggggaagcggtctgtgaagctgccgcggaatcggatgaaacgggaattctcggtgaatatgaagcgtgagcggtccgcacaccgtttaaaatccctgattccggctgctgccggacggctgtgtccgtatactggctgagaagcgcgctgaaattggcaagcgggctttctgaagattgtccgcctgaagccgtgcttgtatgagagattgattgcagcgccattgattgcagctggagaagggccgcccaattcgtgatattcactgtgtcattccacctttttttgtttctgttcataaaaacgctggattttatttttcgtgatccgctctgggatgccgaattgcttgagcaattgttcaaacgcccgttttccttcatcccagtcagcagcttcgaattccaattcaaagtcttctttctctaaatatcggctgtgatctaaaatgattaagcctttttctgattctttttccgcgcgtgcggtcgacagcgttccgaaatagcaaatgtgttctgagttgattccgagaccttccagctgacgtttgacggggccatccggaatcttgaagacgtcaagatcaggtgccgcaagctcttggtgggtttccagcagaccgaccgcggcaggctcttttaacgtcagaacgaacgcgccgtctttttctcggatgcggagtgctgattttttttgtttcagggaaaaatctttcgtgtcgaaataatgattgacctgctgtttaaaatcatgttctttcatgcagagtgcttcactcagcttcagaaattctgattttgtcagcaggtttttgaattcaatttctatttcttgggtcatgacagtcttcctttcaggacgaaaaattgtataattcccattatctctttagaggttacgtttatcaatatcgaccttgatatgataaaataaatgctgtactttgttaaaaaaggagaacattatgcaaaagagaattgaaatccaaaatgcatcattaacagaagacgcgctccgcttgaagtgcggagaggacttaagcggagcggaacgcaaagcctcaggtcaaatgcttgttgattccgatcactttgcttttgtatacatacttgaatcagctgactcttttgaatatgtcattataaaagaacatatctggccggatctgaaagaagccttagaccaaagaaaaccggcggtccttgaggccggcggaaaaacggttgaactttcagggctgcatgaagaactcgattatcttcttgaaaatattaaagataatgcaaactacggagatatggaagaaaaagtgaaaagcgtatttctttagaacaggttcggaattgggggatgtacgatggatgacaaacaatgggagcaatttctagcgccataccgccaggctgttgaagaattaaaggtgaagctgaaaggcgtcagaaccctttatgagtatgaagatgaccactcaccgattgagtttgtgacaggccgcgtgaagccggtggcgagcatacttgaaaaagcgagacgaaaaagcataccgcttcatcagattgaaacgatgcaggatatcgcggggctgcgtattatgtgccaattcgtcgatgatatccagatcgtcaaaaatatgctgtttgccagaaaagattttaccgttgtcgataagcgggattacatagcagagcataaggaaagcggatatcggtcttaccaccttgtcgttttatatcctttacaaacaacgtccggtgaaaagcacgttcttgtggaaatacagattcggacgcttgccatgaacttttgggcaaccattgagcattcactgaattacaaatacagcgggaacattcccgaaaaagtaaagctgaggctgcagcgggcctcagaagccgcatcccggctcgatgaagaaatgtcagaaatccgcggagaaatccaggaagcccaagccgcgttctcgcgaaagaaaaaagcgggagaccgccagtaggaaaggaggggaatggcatgaaatttgccgtttcttcaaaaggagacgaggtttcagatacactgaaaagcaaaatacaggcgtatttactcgattttgatatgaccttggatgaaaaagagccggaaatcgttatttccgtcggcggtgacggaacgcttctttacgcatttcacaggtacagcgaccgtctcgataaaacggcgtttgtcggagttcacacggggcatttgggtttttatgccgattgggttccgcaggagatagaaaagctcgttctggccatcgccaaaacgccgtatcataccgtggagtatccccttcttgaggtgattgtcacttatcatgatgaagagcgtgaggagcggtatctggctttgaacgaatgtacgatcaaaagcatagaaggcagtctcgtcgctgacgtggaaattaaaggccagctgtttgaaacgttcaggggagacggtttatgtctgtccacgccttccggaagcacggcttataataaggcgttaggcggcgcaatcatccacccttccatcagagcgattcagcttgcggaaatggcatccattaacaacagagtgttcaggactgtcggttcgccgcttttgcttcccgatcatcataactgtgtcatcaaaccgagaaacgacgtcgactttcaagtcacaattgatcatttaaccttgctgcataaggatgtcaagtccattctatgccgtgtggcaaatgaaaaagtcagatttgcaagattccgcccttttccgttttggaaaagggtgcaggactcctttatcggaaaaggcgaatagaaagaggaaacggattggacaacttttttatccaaaagaacatgactgcccgggaagccggcatgacgataaaagaatatacggcgcagctcggcatttcaaagcggctactcgctgacattaaattcggcgggggagacctgcttgtgaacggagagcatgtaaccgtccgcaccgtgttagcggacggagacgtgcttaagattgaatttccgaaggagcatgtgagtgaaacgcttttgcctgagccggttccgcttgatattctttatgaagatgacgatgtgcttgtggtcaataaacagccgtatgtctcctcaattccatcaagagaacacccgtcgggaagcatcgctaacggagtgatcagccactaccgaaaaagcggcgtgccatcaacggttcatcttgtcacccgccttgacagggatacatcgggggcgatgctgatcgccaaacatcggctttcccattctcttttgtcagcagcgcagaagaaggggcttgtcagcaggcggtatctcgctgtcgtacacggcatcatgccgcagaaggaaggaacggtggacgcgcccatcggaagaaaacacgacagtattattgagcggatggtaacgccggagggacaacgagcggtgacgcattttcaaacggaaaaagcgggacatgcgtttacgcttgcagccctgcggctggaaacggggcggacgcatcaaatccgggtgcacatgagctacctcggccatccgttagtcggtgatacactgtacggcggaaaaaatgagggaattgcgcggcaggctcttcacagtgagcggctttcattcgtacaccccatgaccggagaaacgctcgtttttcacgccccggtgcctgacgatatgaaaacattaattgaacacatgtaaagcccgaaccgtgtgccggtttcgggcttttttcatgcctgcctgccgtgatcctcgcgaaatcgtgaagcatcatacggcattgagctttccacagagacggtttcgtgctcgggaaaacgaaagcctgtcagttgattgccgaagacgcagcctgtgtcaatgttgattgtacggttgacgatccgggggcgttttaccggggtatggccgtaaacaatccatgccttgccttcgtaagcggcggcccagtctcttctgacgggtctgccgtcgggatacgtttcacccgtgatatcgccgtacagaacaaattcttttaccttacgcgagtatttaccgatatcgtcagcttttatgccggcgtgggcgacaacgagatcgccactatgtaaaatgtcataaagcggcgctgactcatataatcggatgaattgtctggagacttccattctgtcggcgggagacagctctttcagttcggctgccgtcgtttccagtccgtgcatcacttttacggggtttccttttaagtaacgatacagtttgttgcaatgatttcccgggacataacggacggctcctttttcatatgcttttgccacaaaacgcatcacttctacggattttgggcctctgtccgttaaatcccccgcaaagacaagcgtcctgccttcagaatgaacgggcgctccgtctttgacttcatatccgagcttttgcattaacgcgatcatttcgtcataacatccgtgtatatcgctgatgatgtcataagccattcgtgtcagcctccttattaacggttttttatttattatggggctaattcctatacctaattacgctgtttttgcacaaattaaaaaagaattaaagaaataaagccttatcacttttttttcgggttcagccttgttagaatatgcgttatgtttttaaaaaaagtaaggtttcgcccgctttaagcgggcttttataacccttgttttaaggaggtatttacgaatggaacacacatctgtcgcatctttagtcgtcgttctgatcgtcgcttttttgacgccgctccttttacatcggtttaagctcagcatccccgtcgtcgtcgcggagatcatcatggggcttattatcggaaaaagcggcctgaatcttgtcgttcagggagacacgtggctggagacgctgtctgttctcggctttatctttttaatgtttttaagcggcttggaaattgatttttcttcatttgagaaagggaagaaaaaacaattccttccgaatggcaaggaagcgcccaacacgttttctgccgcactgattatctttttcggcatctttattttatcattgctgctgtcctatgcttttgtattagccggttttatacaaaacgcatttttaatgacgcttattatttcgacgatatcactcggcgtggtggtcccgactttaaaggaagaacggatcatgaactccaatatcggccagatcatcctgcttgtcgccgttatcgcggacttggctacgatgattctgctcgcttttttctcttctctttacggagaagacagcggaaatatgtggcttctgttgattctttttgccgcgggggtcgtgctgtatttcttcggcaggatctttaaacaccgttcatttgtgcagtcgatgtctaaaggcaccgtgcagatcggcacgcgggccattttcacactgattatcgtgcttgtcgctttatcggaatctctcggggcggaaaatattctcggcgcgtttttggcaggcgttctggtatcgcttctgtctccgaataaagaaatggtggaacagctggattcattcggctacgggtttttaattccgatctttttcgtcatggtcggggtgaaattggacatttggacgcttttccaagatccgaaaacgttaacgatgattccgctgcttctgcttgcgctgtttatcagcaaaatgttcccggtgttttacttaaagaaatggtatgacaaaagaaccgtgtttgcttcgggctttttgctgacgtccacgctgtcgcttgttatcgcggcggctacgatcggagaaaggctccacattatcagcgccaatatgtccggcgcgctgactttagttgcggttattgccagcatcatcacgccgatcggctttaagaaattatacaaacggcaaagtgcgccgcaggaaaaaaagcgcattacatttatcggcgccaaccaaatgacacttccggttacgctggaactgcctgaggaggaatatgaagtacgggtcgtccatgtgtatcaggaaaatgccggggaaacgcttgcggaatcggttttttcggttgacacgatttctgattacgagcccggcacgcttgagtcgcacggtattttcaaaaccgatattcttgtcgtggcgacgggaaatgaagatgtgaacgctgaaatcgccttaatagcgaaagagaaagggactgagcgtatcatcgcaagcgtcggctcggttgagcatgaaacaaaactgaaagaagagggcatcagtattttttctatccttctgtctacaaagacgctcttgcgcgcattaattgaggcgccgggcgtgatgagcctcctgacgaatgaggagtcttcgttatatcagatcaatctggaaaacccggcgtataacggcatcattctgcgggaatttccgctgatgggcgatgtgattttcgtccggattttcagaggtgtggacagcatcgttccgcacggagacacgcggctgaaaacaggagaccgcctcatcgtcacgggctcgcgcaactacgtgtcggaactgagaaaaatccttgaagcttgaccaaattgcaattcgtgataatatagaaggcataacaaataaatcattaatcgtatgaccactaggggtgtccttcataagggctgagataaaagtgagacttttagaccctcataacttgaacaggttcagacctgcgtagggaagtggagcggtatttttttggggttccttttatccatttaaattccaaaccacttttccgatgcgggaaagtggtttttttattttatcaggggggaagacatgatgacattttctgaagaatgcagacaggcggctgccgaatggtgggacggaagttttgttcatccgtttgtaacgggaatcggtgacggaagcctgccgatagaccgtttcagctattacgtgctgcaagattcctactatttgacgcattttgcaaaagttcaggcgttcggcgccgcatatgccgaagacttgtttacgacgggcaggatggcgggccacgctcaagggacatatgaagcggaaatggcgctgcaccgcgagtttacggagcttttagggattacggaagaagagcgtgcggcatttaaaccggcaccgaccgcctattcttatacgtctcatatgtacagatcggtgatgagcggcaattttggagaaatattagctgcgcttctgccctgttattggctttattatgaagtcggcgaacacttaaaagagtgcaaaccggagcatccgatttatgaaaaatggatcggtacatacggcggagactggttcagacagcaagtcgaagaacaaatcagccgtttcgacgagattgctgaaaacagcacagaggacatcctcgcgaaaatgaaagagaattttgtgatttcaagctattatgaatatcaattttggggaatggcctatcaaaaagaaggctggtccgagaagggcggaaaagaggtggaatcctttggagctgcacgcggtaactgataatcgcaaacccgttgccgagcttgccgaggatattctttcgattcagcgcgaagtaagctttatccatatccgtgagcgggataaaacagcgggagagatcatgcagcttttgtcccttttgaaaaagggcggtgcggataaggacaaattgatcatcaatgacagggcggatatcgcgctttttgccaacatacaccgtgttcagcttccgtcccgcagcttttccgtaaagcaggtgcgaagcagatttccccatcttcatatcggacgttcggttcattcgctgaaagaagccatccaagctgaaaaggaagatgcggattatgtggtgttcggccatgtatttgaaaccgaatgtaaacagggacttgaagcaagaggcatcagcctgctttcagagatcaaacgcacgctttccatccccgtcatcgcaatcggcggaatgacactgcagacgatcggacacacaaagcaggcgaaaccggacggaattgccgtcatgtcaggtattttctcagctgaaaatcctgaggaggcggcaaaacggtatgcacgcgcggtaagggaggccgattatgaagaagcactatgatacagcggtgatcggcggcggaattatcgggtgcgccatttcttatgagctggcgaagacgcagcagaacgttgtcttgtttgaagccggagaagtcggccgaaaaacgacaagcgctgccgcgggaatgctgggcgctcatgcggaatgtgaaaaccgggatgcgttttttgattttgccatgcacagtcaaaggctgtatgaagcggcggggcaagagcttgaggaagcttgcggcattgacatcaggcgccataacggcggaatgcttaaactggcgtataccgaagaagatatcgcccgtctacggaagatggatgatctgccttccgtcacctggctttcagcggaagatgcccttgaaaaagagccttacgcttcaaaagacattctcggcgcaagttttataaaagacgatgtccatgtcgaaccgtactatgtctgcaaagcgtatgcaaaaggagcgcggcgctatggcgctgacatatatgagcatacacaagtcacctccgtaaaacgggtgaacggagaatattgcatcacaacatccggcggggatgtctatgctgacaaagtcgcagttgcaagcggtgtatggagcggccggtttttcagccagctcggcttgggacagcctttttttcctgtgaaaggagaatgcctttccgtgtggaatgacgataccccgctgaccaaaaccctttaccatgatcattgttatgtcgtcccgagaaaaagcggccggcttgtcatcggcgccacgatgaaacagggcgactggagcgatacgcctgacatcggaggaattgaggccgtcattggaaaagcgaaaacaatgcttcccgccatcgaacatatgaaaatagaccggttttgggcgggtctcaggccgggaacaagagacggaaagccgtttatcgggcggcatcctgaagacagcggcatcatcttcgccgccggccattttcggaacggcatcctgttggcgccggcaacggctgaaatggtgcgggatatgatcctggaaagacagattaaacaggaatgggaagaagcgtttcgaattgatcgcaaggaggctgttcatatatgatccttcagctgaacggaaaacaaattgattggaatcgaaatgaggggacggttcaggatttgcttgaatcgtaccagcttgatcaaagaatcgtagttgtggagagaaataaagaaatcattgaaaaaaagaattatgaaaatacaagtttgtgtgaccgcgatgtcatagaaattgtccattttgtaggaggcggatgaggatgttaacaataggcggaaaacagtttcagtcaagattgctgttaggaacgggaaaatatccgagttttgagattcagaaagaggcggtggctgtctcggaatcagatattttaacctttgcggtgcggcggatgaacatctttgaagagtctcagcctaactttctcgaacagcttgatttgtctaaatatacgcttctgccgaatacggccggtgccgcaacggctgaagaggcggtccgaatcgcaaggcttgccaaagcttcagggctttgtgacatgataaaagtagaagtcatcggatgcagccggtcacttttgcctgatccggttgaaacgctgaaagcatcagaacagctgctcgaagagggatttatcgtgcttccgtatacgtcagacgatgtcgtgctcgcaagacgtcttgaggagctcggagtgcatgccattatgccgggcgcttccccgatcggttccggtcagggaattttaaatccgctgaatctatcctttatcattgaacaggcgaaggtgccggtcattgtcgatgccggcgtcggatcttcaaaagacgccgcctacgcgatggagctcggggctgacggcgtgctgttaaataccgctgtgtcaggcgctgatgatccggtcaagatggccagggcgatgaagcttgccgtagaagcgggccgcctttcttatgaagccgggagaattccggtgaaagattacggaactgcaagcagtccgcgagacggtcttccggtatgacggacagatattccagacaggagctgtttcagccgatcggtccctcaggccaagagaagctccggtcgtctcatgccgtgattatcggcgcgggtgcgcttgggacggcaagtgcggagatgcttgtcagagcaggagtcgggaaggtaacgatcgctgacagagactatgtggagtggagtaatctccagcgccagcagctttataccgaagacgatgtcagacaggaaatgccgaaagccgcggcggctgaaaaacggcttcgatctataaatagtgatgtagaggtcgagggatttgtcatggatgtcactgcggaaaacgcacccggattgattcgtggcgcctctctcatcgtggatgccgccgacaactttgaaacgaggctgattgtgaatgatgcggctgtgcagaaagggattccctttctgtacggcgcctgtgtcggcagctacgggctctcttttaccgtcattcccggtgtcacgccgtgccttcactgtctgcttgagacattgcctttaggcggtatgacatgcgatacggcaggaatcatcagcccggctgtattgcagacggccgtttttcaggcagcagatgcgctgaagctgttaacgggcggatctatcgagcatgttctccgttcctttgatttatggaaaaatgaacggtcagaaataaacgtcgcccgtcttaagtcggctgattgcccaagctgcggcacaaacgattatccgtttttatcctatgaaaatcagacaaaagcggcggttctgtgcgggcggaacacggtgcagatcagaacggggatctccgaacagtttgatctgcaaaaacttgcgggacagctcagacggacagggcttgatgtttcagccaacccgtatttaatttcgttttgcacagacaagttcaagatggttctgtttcgtgacggcagagcattaatacacggcacaagtgatatcagcagagcgaaatctttttatcataaatggatcggataatgcgaaaggagagaagaacatcatgagcatatgcaaagcattgacgattgccggatcagattcaggaggcggcgccggtatacaggcggatctcaaaacctttcaggagctcggcgttttcgggatgtcagccattacagcggtaaccgcccagaacactttgggcgttcacggcatttatccgctcacccgggaagcgctgggcagccagattgacgcggtggcggaagatttgcggcctgacgctgtaaaaacgggaatgctgtggagcgcggaaatgattgcggaaattgcggaaaaaacggatcagtacgggcttgatcatgtcatcaccgaccccgtcatgattgccaaaggaggcgcttccctgctgcgtgaggaatctcaggccgcgttaaaagaactgttaattccgcgcagctatgcggtgacgccgaatgttccggaagctgaggtattgacgggaatggaaatccgaacgtttgaggaccggaaaaaagcggccgaatgcctttgcaagcttggtgcaaagcatgtcatcataaaaggcggacatcagcctgaacaggggagaatcgttgatttattatttgacggttcgtcttttacccaaatcagccacgcttatattgacaccaaacacacccacggaacaggctgcacgttcgcagccgcgctgacggcggaaacggcaaaggggaaaaacattcagaccgcgtttgagacagccgtcaattttgtgcgggaagccgtggaacatacgctcggcatcggagagggacacggcccgaccaatcattttgcctttaaaaggaacagtctgcagacgagataaaaaagagaccgcttcaacatccgcggtctttttcccatgctttcaatctggacaaggttatgatatgataaaaattaagatcaggtactaaaactatgtctttaagacgattacaggaggctttatacatatgaatttctcacttgaaggccgcaacatcgttgtgatgggcgttgccaataaacgcagtatcgcatggggaatcgcccgttcgctgcatgaagccggagcgcgcctcattttcacttacgcgggagagcgcttggaaaaatcagttcatgaccttgcggctacattagaaagaaatgattccatcatccttccgtgtgatgtgacaaatgacgctgagatcgaaacttgctttgcgagcattaaagagcaggtcggcgtgattcacggcatcgcgcactgtatcgcgttcgcaaacaaagaagagcttgtcggcgaatatttaaatacgaaccgcgaaggattcctgcttgcgcataacatcagttcttactctctgacagcggtcgcaaaagcggcgcgtccgattatgacagaaggcggaagcatcgttacactcacttacctcggcggagagcgcgtcgtttcaaactataacgtaatgggtgtggcaaaagcgtctcttgatgcgagcgtcagatatttagccgctgacttaggaaaagaaaacatccgcgtcaacagcatttcagcaggaccgatccgtacgctgtctgcaaaaggaatcagtgatttcaactctatcctgaaagaaattgaagagcgcgcgccgctgcgccgcacgacaacacctgaagaagtgggcgacacggctgcattcttgttcagtgacctgtcaagaggcatcacgggcgaaaatcttcacgttgattcaggattccatattaccgctcgttaaataacaagcagtccctttcagggattgcttttttctttcttctgattttaatcattccgtcatataaataaaacatgacagaatcggagggatgaagatgtcaaaacaaaacagaaacgcggaaaaaaaaccgctcatgtatattgttcaggcggattattcagacacgcaatcatcaatgcaggacatattaatcaaaaaaaggaaagcgcctcagccgccggaagaagagccgatgcatggaaagcgggaggaagaatgtcaaactcagcctgaaggagcagtggctgtcgaaccagaaaagcaagtacctgaacagcacagccgcgcagaagaagccgttcaagaagttccggcgcaagcagagcaggacactgccaagcctgacgccgctaaaaaagagtctgatgccgctgaaaaagagcctgaagcggttcacaatgccgccccagaggaaaaggttccgccaaagcgcgtgaaaaagccgatgagcagaatgtccattcttgaaaaaattgatttcttaacgaagctgccgcataatatgccgcggaccctttgtctgatagaagccaacgggaaaacctacagaggcgtaatcgtcggcagaaaaaataatgcgatcttcctgcggacgacaagcaacggagcgccggcagaactcgcaatagacgatattacctcgctgcatccgcttggattttaaccatacaaaaagctgcctgaattcttaatccggcagcttatttttatgctttttgatttaagaatgtgtgcggttgatcagtctcgggttcaggcaattgatggcgcagaagctatggagatcgacttcaacgcaatagttcgttttttctaaacggaatacatcgcagagagagtctttatctgtaaaatcaagaatgtgcttatgctcgtcaaaagcaataagcaggcttaatgtggcacagccgtcacagaccctttcaactctgaaaaaaacggtgttaaaacacggaccgttatccagctcgccgacatttccgaatgcggtaaacggtgatgatttagaagtgaaaagcacaaacggcactgtatcgcctaatgaaaaacccggcgataaaaggttggaatagcatccggccgggcaatcttcctcgaccgcattttgcaggtcttcaatattttctaccgcttcacgcacacagtatgttgtatgcttgctcataatatccctcctgacttcacgttttatataccggattaaacgatatcggagagtcagccgcccggaagtccgggcgggctgatgattgcatctgtaatagaaggttggaaggggattcttctttaggaaagatgcgaatcaatgactatccgtgatgctttttctctttgtgcggctcaggccggtcaacaagctccggtgaaaggcattgaatggcgctgaagcagctcagatcaacttcaatgcaaaaatctgttttttctaaaccgaagaaatccgggtcacaaggatggcagacgctgagggtgtcgccgtgcacatctacggggcgcaatactgaaagcgttgcgcagcaatcacaaactctttctgcccggaagaaaatagactcgaagcactggctgtcatccgcaaagcctccgacgttcccgaatgtggagaacaaaccgccttttttatcaaacaagagaaacgggatggtatctttaccggtaaccgtcgggcttaacagattggtatagcatccagtcgggcattgttcttcaacagcctcttgttctgctaaaatcttctcgactgcatcgcatacacaactttcatctcggccatggtgttttccgcagctcatggatttcagctccttcttttagggtatttgacttttgtctttaacaacatatgtacgcgagcctcacttggtgtgggtgaacgtctatatattcatcatatgcggagaaaataagaaaaagcagagcatttttagctctgctttttctttttagaggacaagggtgatgactaagacagcaatcagtaaatttgtcgctgttgagatcaaaactgcgatatcggcatctactgttgtcacgtttacgccgcgggagttttcgatgagcagtttttgacggttgatttgtttgttagctgttagctgcaataagtcttgtgcgaccaattcagcgatgactccgtcagcgattgaagtgagagtggccgttacgactgctgcattaatcgctgtcatgactgaagcgactgcctgaacgtctgttgacgttacgttaatatcacaagagtctctgataataatcgcttcttcagaaacttgtttgttgatattcgcttgagcaaggtcttggtcaaggaaggcattatcttcgccaaatccatgtccgttacagcaaacattacatcttctgccttctttttcttctttttcttctcgcggatgttcgcattcaggatcaagtgcaacccaagagtatggtctgctttccatatctattcctccttttcttttactattattaaatgagccggccccttactttgactcaggcatctatcctgataaaaatcactattttttagttattgaccgggattttggcgtctttgccggagctgttcgattaattgttctctgcgggtttgcggattggtctgctgatcttgcgctttttcctgctcttttttttgtttctggctttcaagaaaagcttctgtttttgcctgcatgtctttgactaatgcgatcagcatttctttttcttcatcaggtatttcccgcattttatcttttgtcacgccgtgttttttgaagacattgctgacaagcacctttaaaagcggatccacttctggtagattttcgagttctttttttaatttttcgttatctgccatttgttctcacctctgtttaaatatttgaaaagaaaggttaaaggatgtctagttcagcaaaaagtatatttaataattgaaacaaaatttgtacaaaggccataatatcgtctgctgtcagtgtgattttgacattgcggctgttaatgacttgaatgagggttcgcttttttatttggcaatcatcgaggatcagcagttcggttgccatttggtcggctgtgtcttcatctgcgatcgcgagctgtgtcgcaaggataatcgccgcagtaactgaagcttgtattgaaagagcggccgttataagtgttgtatctattgtgacattttcgcaatcaatcacttcgatcttctgctcgaattcgttggataattgttcgaatatttgcggctgcagtgtttcgactttttcttcaaacgacataaccttcactcctttctcattcatactttatataatgcaaatgaaacgccgagcggaataagaaaaacaactaaatcgcacctatttttttatcggacaaggtgcgattcatgaagatcagggttttcgcatatgtataaagaggtcaagttttgaaaaggagtgaacaggtggttatcaattggctttcatttattctgttatcgtttgccgttttccggctggccaggcttttcgtatttgacaccattatggcgccgcttcggagcctttttcacgaggaaaaaacagaaaccgaaccagacggcacgacagaaacctacattgtcataaaaggaaaaggcatcagggcatttatcggtgaacttctcagctgctactggtgtacgggcgtgtggtgcgccgcctttttaattgcggcccagattgtggtacccgaggctgcgcaatggctgattttgctgttagccatcgccggcgcggccgggatcattgaagctgcggtttctcgtcttctgcaggaataaggcggttccaccagcaacttaccgtcactttcggcataaactggcatatatgacataaggaaaggaaggatcaccatgaatcaatcaagcaaaccttcccaacattctccatacaagtcaactgtgcatcagccttacgaaaaaaaaattaagaaaaaaggctgcggctgcggccaaaagaaaaaaccgaaatagccgttttctaaaaaaccggaacttccggtttttttgttttttgccgaacgccggcctctgttcggcatagatcataggaggaggggatgttatgaatatatttgaatcattcataaacggtaaataccgccggcacaatcaaaaccagcgggagcatgacaaatatatcttatctattgaaaaacagctgtctgagtttgatgaagcgggatcgcgctttgaggaatggatagatgtgtttgccgccgaaacagaagcaaaactgaagaaaaatgagcattctcactaaaatgaatgaaatccgcaccggccctatgcatttatccaagccaaacaagtcggctcacatagagtatagagagtaaaggaggtgcttagatatgggattcggatatggcggattcggcggcggctacggcggttatggcggctgcggcggatacggaggcggctatgtcggaggcggatacggctcaacatttgttcttgttgtcgtattgttcatccttctgatcattgtcggtgcatcctttttttgctaaaccttagcaagaccttggataagcgcgggaccgttcagtcccgtgcttccctgatgtatgaaggagtatagagacggggcactcggaattttttccttgtcttacgggcacatgttccgctctttattcatacaatatcgtattactccacaaaaggaggcacaccatggataatcaatttttcaaaaatattgagaagaaaacaggcgtcagcatgaaggatgtcatgaaccttgcaggatcattgcaaaatgccaatttcaaagatgaaaacacggtgagaggcgtcattcagaaggtgtcccagctggctaacaagcgtgttccgaaagaattggaagacaaaatcgttcaatctattacaagcggtaaagagaaacttgattttggcaccatttctaaaatgctgaacaataaataggcatcagccggccttgctaaaaaggcctttttatgtgagaagaacccggcagcgatctgccgggttctttatatcctgagtgcgctccgtctgtccgtccgaagaaggggctcgagaaatcttgagctgcgcgctgtttttccccgcctgtacgcgggacaagatacatataaatgctgcatggcccttgtcattgcgacatacagaagccgtctttcttcttcgagcggagcgggatcgccctgtctcgccgtctcaagcgcgaagtcatgggggatcgagccgtcagccgcgcctaaaatatagaccgtattgaattcaagacctttagagcggtgaatggtcagcagttcgacgccgttttcatcggttttcagattctcagcggcgcgcatatgatcgacatgcgcaagaaaatcgggaatggttttgaattttttggcggccactttgacatccctgagatcatcagagcctttttccagtttgttcccctcattgccccgtttttttaaatactcggaaaaacccattttgctttctgcaaaggtgatggcttcaaccggcttcattgtccggatgcttgcgaaaaacggaacgatctgcttgatcttccctatttgaaaaggcttcaggtcaggcagtttcgtcagtgccttaaccatcgtgcaatcttccgtgattgacagcgcctttaacgtttgcagggcggattgctttaaaaataaggcgggcagcaggtctttcaccgcatccggatcatcttcattctgactcgcatataagtaggcgaggatctggcgtacgattctgcggctgtagaacgtctgcacacccctgtcggcatgataaggaatcgatgattggtgcagtctttcataaatggcccgtccggcgctgtttgtccggtaaagcacggcaaaatcgtcaggactctccccgttttgaattttctctttcatatccgaaacgatcatggtcgcttcttcttcttcatcgtaaggataaaacagcacgggattgtgaacgccgtctttgacggcagaaagtgttttttcataccgttttttatttttctttacgacggcatgagcgcttgagacgatcggatgcggcgatcggtaatttgccgttaaataaatggtctttgctgccggataatccttttgaaaatctaaaatgaaagacgggctgctgccgcggaatgcataaatggattggtcgtcatcacccacgcagcacaggttattctcagggcttgcgatcatttgcataatgttgtactggacaggattgatatcttgaaactcatcaatcaaaatatgagaaaatctgttttggtactgtgcgagaatatcaggccggctttgaaacagttcataacagccttgggccatgtcatcaaaatcaaattgccgtttttcccgcttttgccgttcgtaatgttcgtagagcctgtacacttttttctcccagtcgtccgcaagcggaatggtctcatgggggagatatgtgtttttccagcagccgataagctgaagcgcctggtcgacgggaaactctttttcatccaaattttcttcatagagcgcctttttcacatattgctctttttgccactccatttttaaaagctggctgccgttccattttgaagaatcataatgatagagtattttatagaaaaagctgtggaatgttcctgtcacgagacgggagacttttccggctgccagaccgtactcatttgccatccgctctttcatttcggcgacggcttttgtcgtaaaggtcacaagcagcatattctcaggtgaaatgccgaggtgttcaatcatatgggcggcgcgtgccgtcagcacccttgtttttccgcttcccgctccggcaagcactaacaaaggcccgtccgtttcagtaactgccttcatctgttcacggttcaggccgatgccggggaacaaagatgtatcagccgcctcggatgttggtgaaaacggttcggccgcaggcacttttttcgggcttttccattctgagacgatcggtttcggattctctgaaatcgcttttcctttcggcagacggaacatgcctgcttccttatactcttctttttctttctccgcttgcggttcctcggccgcgcatgctttttcacaggcggtgaagtctcccttttgccggtgataaaatgccggctgctctaaaatcgaaagccgcatcaagacgggctgctcacaatgtgcgcaaaaaatatttcctttctgagcttcttcaaaaaggaattggtaatgttctctagaatatttatgtaaatgtatcgttcggttattcagtcgggcgcatttcaaaaaggggtcctcccattaaaaggtgttcatccatttgatagacaaagaatatcataacaaaagaaccgcgtttcaaaaagtaagattaagggaaatgaaaagcgaaggggaggggtacatatgatttatgcgggacggattcaaaaccagcagtattctcaatacgcaaaccgggcagcgggttataagcctgattacgccgacattacgaaagcagccgccctcgccaatgacagggtgtacagagaggtggaacgccgccaggaaaacaccgcagccgcagaaaagaaagtacttgaggaaaaacgtaagcgctctctttcccgtctgccgcaaatcatgggaaaaggccggttaataaatcaatacgtgtgaaaaagcccggatatatccgggcttttttgagtcgtatatatgaaagatacggaaaggaatgattcaatttgagaaagctttcattattaattgcggggttatttctattcggcctctttactgccggaatgaaaccggcacacgcggcggatggctccgcagcaaaagatgtcactctcacacagctggcgccgcatgtttggatgcatacaagcaccggtacggcagacggaagtcccgtccctgcgaacggattgcttcttgagacttccaaaggaatcgtactgattgatactccgtggaatgacagtctcacagagcaattaatgacacaaataaaaaagcggtttccaggaaaaaggatgaccgatgccattgtgacacacgcccatgacgatcgtatcggcgggctgaacaccctgtacaaatacggtgtaaaggtgcacagcacgaagctgaccgccgacttcgcccgacagcagggatatgaccggccgctcggagatttgaaaaacgtgacaaagctgcagtttggcgatatgaaaattgaaacgttttatccgggaaaagggcatacggaagacaatatgaccgtctggctgcctgaggataagctcttattcggcggatgcttaatcaaggctttagaaacaaaggaaatcgtgcctactccgggcttttatccggatcagtggccgcgcgccgtccgcaaagtcatgaaaagatatcaggacatcagcattgtcgtcccgggccatggcagtccgggggatgaccgtctgctgccgcatacgataagccttctgaaagaaacgtaataaagaagaccggcgctcccattacggagtgccggctttttttatctcttcctgattttcataaaactgaggaaagcaagtgcaagcgccaaaacggtatatcccgctatcggccaaatatgctgatgaaatgaagaataatctccggatatgacttcctgggccagctcgatcgagtgaataaacggtaaggcataagcgatatgtttgaatgtgtcaccgagcaggctcacctccatccaagccccgcccagaaattgcacgagtgtaatataaatcgttccgatacctgaaatttgtttgtccgtaaacacagcccctaaacataaaccgaagaaaacggacatcatcgcaatcggcagcaagacagcgatacctgcgagaagattcatccactcggcggataaaccggcagccgctgctgcgataaaacaaatgacgatttgtaaaatggctaacggcagcatcggcagtgcataaccgatgacataatcggctgtttttaaaggggaagcaaacaaacgggtcaaaagggcggtctgtttgtcttttgcgatcagcaatgcagagaacatcgtaaggaaagcaaaaccgaaaacaatgagtccgggtgctaaatgctgaattttaaaggtatcaagcggcgcatttttttcaatcgccgtaaacagaaacaatagaataacaggcagtgcgattccaaggataatagacagggggtcacgaaaaatttctttgcggttgcgaatggcgaaatcaagcataaagacccgcctccccgtcacaaatcgctaaaaaggcatcttcaaatgtggctgaatgagtttgctttttcagagcctccgccgtgcccagtgcttttaaagtcccattttctaaaatgcaaatacgatctgccagggcttcagcctcttctaaatagtgtgtcgttaaaataatcgtcatgtctccctttaatgcctcaagatttttccacaactcgcggcgtgaacggacgtccagccctaatgtcggttcatctaagaaataaatatccggcttggtgatcattcccattgcgatgctgaggcggcgctgcattcctcctgataatgtttttgtttttgctctttctttctcttttaattgaaacaattcgagcatctcatccgttcttttttttgcttcttttttcggaattccgtagactccggctataaactctaagttttcccgtacggttagatgaggagcgatggctgtttcctgcggggacatattcaatttcggttttattttatccaaatcagtcaaaatactgtgtccaagcactgatgcatcaccgtcatccggagaaagaagtccgcaaagcatactgattaatgtcgtttttccggctccgttctcaccgagtaaagcgaaaaattcccctttctcaactgagaacttaagacggtcaacggcggcggtttctttataatgtttcgttaattgcttcagctcaatcgcatgcatttactcatcctcgctatcttcatcgatttgcttagcgtttaaaatatcttttgcaaactcgaaaaagagttcttgtttaacaagtgcgataccttgctggtcatccccaagcataagcagagaatcccccggatttatatcgaaaacatctcttgcttctttaggaatgacaatctgtccttttgtgcccactttaacagtcccgaatatatgctttccttttggtgccgtcatgtttatccctccgaaatatgaattgtattttttgtatgaattgtaatacttcgtatactaaacatacattaaccttccataaaatgcaataaaattcatgaaatagtattattttcataaaaaaagcactcctgctataaacaggagtgcttttgattttatcgtttgtgttcctttaccatttccagatgggggatgcccgcatcgagaaattcttcgccggatgtaacgcggtatccttgtttttcgtaaaacggaaccgcctgcgtctgcgcatgtaagagaaagctgtcggcgcccttggctgccgccgctttttcaagcgcctgcataatgacggctccgacgcctaaagaacgatggcttttcatcacgcagatgcgttctaattttccatgcccgtcttttatgcgccatctgccggctccgaccggctggccgccgtcatatatgactatatgttctgacgtgtcctcgaattgatcaatctcttcttcttccggaacgtgctgttctttaacaaagacctcttttctgacgaaaaaagcgtcgtttagctgtttttcagtttttgcgatgatggattccaagcagttattctcctccgcctaataaaaatgtttcgtacacagtccatgagccgttatccagctgatagagcaggtgaaaacggtcgatgacttcttcgtgggaaatgtcctgcattttcagctgtccgagtacgtcggaatgttcatctgacgacagcttctggccgaccgtgacatgcggaacgaagctgtattccggctcgccggataatgttcctgagtagcatttctcactcagagattttaattcctccgtcggttctgctttcatatatatcacattattcacaggagaaaacgagctgtattttgtgattttcagaacgagcggatgcgactctttcgccgtctgtctcagctgtgatacgacctgctcgatttcctgttctgtcgcttcaaacggatctcttaccgtcagatgcggcggaatgagcgcgtagctcgggtcgtagcgtttccggtacgaatttgcgagatcctgtaatttttttgatggaaataaaacaataccgtatttcatgaaagttccctccttaaatgaatggttacagcatttttttcagcgccggcgtgatgagcggctgccagtaggtccatttatgatccccgtcgaaggtttcatacgtgtattcggactgtttgctttctagcagctgtttgagctcttcgttcggcgcggtgaaatcaagaacctggccgtccgtcgtgtgaacgccggtttctttttctccgatttgatgataaacggaaatctgtttgagatcctccgactgccggacggcatccagcacgtgcccgtcaacatacggagactgcatgatgacgtttccaaacatgttcggatagtcaatcgccgtcatgagcgaaacggttccgccgagggaatccccgatcatggtgcggccgtatccgacttgataagtcgggtattctttgtcgataaaaggaacgagctcattggcgataaaccgcttatatgaggcgaacttagagccttctggatggtatgtgtttcttcgctcccgcacatttttataagggacgccgataatgatgcagcggtcaatttccccttttgacataagctcttccgcctgccgcccgattctccctaatctgaaataatcatggccgtcctgagcgatgaccgtatgatatttatacaggggggagaaggtggcgggcaggtagaccaaaacggtcatttcctcttcaagctcatgggagaaaagttttttctcatgaatgattccgtttttcgatgccacttcgcattcctccaggccgcttcttgtcttgatggttttttcctattgtaccatgaattattagaaatttcttttttcaggtgcacttcttgcgagagttcagataaataaaaagttgttgaaatccattttattgtgcgttaatatagaacaatcagaaaatacaaaacaatattcttatcacgagaggtggagggactggccctttgaaacctcagcaaccggtttgctttgccgcgggaaggcaaagtgccaaggtgctaaatccagcaagcgattcacatgcttggaagataagaggaagagaaaagctccttcttcttatgaagagggggcttttttatttttgaaaaaggatggtgcttactgatgacgcagcatgttgatacaaaattagcccaaatcggaaatagaagcgaagaagcaacgggaacggtcagtccgccgatttatctgtccaccgcttaccgccatagaggaataggagaatctacaggttttgattacgtgcgcacgaaaaacccgacacgccagctcgtcgaagatgccatcgccgtgttggaaaacggtgcgagaggatttgccttcagctcgggaatggcagccattcaaaccattatggctttatttaaaagcggggatgaattgattgtatcctccgatttatacggaggtacgtaccgtttgtttgaaaacgaatggagaaaatacggcttaagctttatttacgatgatttcagcgatgaagactgtttacgctccaaaataacggagaacacgaaagcggtatttgttgaaacaccgacaaacccgttaatgcaggaggcggacattgaaaaaatcgccaggattacgaaagaagccggcctgcttttaattgtggataatacgttttataccccggtgctacagcgcccgcttgaactgggagcggacatcgtcattcacagcgccacaaaatatttagcggggcacaatgatctccttgccggtctggctgtcgttaaggatgaagagctcggcgagatcatgtttaatcaccaaaatgcgatcggagcggttctttcgccgtttgattcgtggcttttaatgagagggatgaaaacactcgcactcagaatgcgccgtcatgaagaaaacgcccgtgaacttgcagaatttttagaacaggaagaagaaatcgccgacgtgttatatcccggaaaaggcgggatgctgtctttccggctgcaaaaagaggaatgggtcaatccgtttttaaaggcgctgaaaacgatctgtttcgcagaaagtctcggcggggtggaaagctttattacataccccgcgacacagacgcacatggatattccggaagacatccgtatcgcaaacggcgtctgcaaccgtctgctgcgtttttcagtgggcattgaacatgcagaagatttgaagcgggatgtcaagcaggcattacagcaagtaaaagagggggccgtatcatatgagtaatcacaattggacgctggaaacccagcttgtgcacaatccatttaaaacagacggagccaccggagccgtcagcgtgccgatccagcatgcttccacattccatcagtcttcatttgaagaattcgggacatatgactacagccgctcaggcacaccgacaagaacagcgcttgaagaaacgatcgcaggtcttgaaggcggaacgagaggttttgctttcagctccggtatggcggcgatttcgacggcatttctgctcttatcccaaggcgaccatgtcctcgtcacggaggatgtgtacggcggaacattccgcatggtgactgaggttctctcccgtttcgggatcgaacatacctttgtcgatatgacggatatcaacgaagtggcgcggaatatccagccgaacacaaaggtcatttatatggagacaccgtcaaatcctacacttggaattactgatattaaagcggttgtccagcttgcaaaagaaaacggctgtctgacctttctggataatacattcatgacacctgcactgcagcgtccgcttgatctcggcgttgatattgtgcttcacagcgcaacaaaattcctgagcggacacagtgatgtgctgtcaggccttgccgccgtaaaagatgaagagctcggcaatcagctgtataagctgcaaaactcgttcggcgccgtccttggcgtgcaagattgctggctcgtgctgcgcggcttaaaaacattgcaggtcagactggaaaaagcgagccggacggctgagcggctggctgcctattttgacgggcatcccgccgtcaaaaacgtttactatcccggccttgccggacacccgggagccgatacccataaacgtcaagcgagcggagcgggcgccgtcctgtcctttgaattggaaagcaaagaagccgtcaaaaagctggtcgaaaacgtatcgcttccggtatttgccgtcagcctcggcgccgtcgagtccattctctcataccctgcagccatgtcgcatgccgccatgccgaaagcagagagggagaaacgcggcatcacagacggccttctgcgcctgagcgtcggagtcgaaaacgccgaagatttagaacgggacttcgaacaggcattgaaaaaaataacccccgcccaagtgagatcataaacgaaaagggcgccgtcaattttgcgacgcgcccttttttttattttagataaaaaaagtgttgacgaatgagaaatcaggatatataattataaatgtcagagagacaacaacatacccagcaacacatacatatcatgattccgtagctcagctgggagagcgctaccttgacagggtagaggtcgctggttcgagcccagtcggaatcatcaagggtttcagcgtgttggacacttactcgtgtcacactggagtcacaaaaaagaggagtcacaatttaatgtgattcctctttttgtttgccttgtaagatgccactgataaatgtggaagcatccttctgcatgtttggcattaaatgtgaataggtgttaagtgtaacctggatatctttatgtcctaacctttcttgaacaactttaggatgaaactttgttaacagtaaggatgcatgagagtgtctaaggttatggaatgggatatcaggtaaatcaagctgctttaaataagctttgaactgtcttaaaaggtttcttggattgattgcattccctgtatctgtacatacaactaaatctcggtctgtatagagccctccgcataagttcttctctttcagtacacggcttcgttgtttcttcagtatatggatatcatgttctgataagtcgatggtgcgtgtgcttgtcgatgattttccaccgtattttgtttggccgccagagtgttctaatgtttgaacaattctcaaaacaccattattgaagtctatatccttaaaacgtaaacctaaaatttcaccttgtctaagcccgaaagaaatcgctaaccaaaatgcgatatagtaacgactgtttttagtgtgatccaggaataaagacatctgttccgctgaccaaacttcaacttctttacgcttaactgatggcttcctaactttttcaactgggttctttttaataaactcatcttggacagctgttttcattacattgttgagtacgtgatatatcttctttattgtggcagctgataagccggcattaactaaccttgttataaatgcttgtaccttttgagttgttatatcgcttagtttcatgcttccaaaggcggggagtatatgatttttcaaattataatgataaacctttagagtttggttgcttacatctggagttttgatgttaagccaatactcaaccaattccttgaaggttgaatcattatctttaagaagatccccagagtgatataactggagatcttctcttaatgcttcttctgcatctttctttaacttgaacccacttcgtttacgctgcttccgtctgccgttctcgtctttccctatatcaaacacatagtaccaattgccgtttctcttatctttttttactgatgccattaatcgttctcctttttatttttaccagctagggcgctctccccacccggtattgcttttttcgtaaccttcttttaatgcactgataacatgttccttagcgtctttattgaactttgttatatctttacggaataaagaaactagaaatcggaagttatcaggggaatctcccattgataacatcagcttatgaagattttcgatgactgtgccgaattcactaggatttatcgtatagtaccaatcaaggtcgtttttaatctcatttatttttttatttatcatttcatcatagcttgcatgttgctcttggattcgtatagcttcagcttgttcaagtaagtgtttttggtactcaggatcattcattaactcaatttcccgttcgatccaggcttcttctgctgccttttcagctgctattttttcaggagacttaaaaccaagagcttctaagtacatttctaaattctcttctgcgattccgagctttctaaatagttctaataatgtgttgtaatccggattcttgttgtgtccattttcaatttgactaatgtacgctccggacttacctaacgattttgatagctcttgagaattgatcttctttttcttcctatagtatttgaccactgatcctaacttgttttcttcatcaatcttaatattattatccatgattataatgtcacctcaaaaataatcataacatatggtgaataaaaagaatatatttattattttcttatggattacgataaaactttaataaaaataaaaaaactttcatgaaaagtattgaaatattaatgagtgtggtttatgattggattaacccgaaaaggaaagggttaaacaggaaacagaagagaggtggacggatgaaccaagaggaactaaaccaagagcaactggaagaaatcttcaaaaaggttgcgcttgatgttcaagatattcgcaaaattactggggctggaagagatacagcatatgccctttgtaagagtgggaaatttcacgcagtgcgggtagggaaaaacagaatcaaagtaccaacagaaggtttcaaaaaatggtggtacggtgagcaacaaatcgctcaataggacataacagcaacaccgcaatacataatcgcaatacataacttgttccataaaactggaggatgaactataatgagatcatatgttctgtgtgaactaaaagagatcctatattcagattcgggttagtggtgacatcgccactgtctgttgctctgaattagtgacacactacagggggttattcggatgatagcaaaagagagagaagctaagaaaccagaagtagatgcaaaggtacgtcttgaaatgtcagatattaatgaacagtatgaacaaactgacgcattaattgatcaattaatcaacagtagctgttcgattgaacgtgaatgggcagcaatgtatcagatcaaacgtaagcaagacagaggcgaaataaacgcacatcaggcgcttaaagcaattgggaagcttgatcccaagtctcaagaaatgcgtgtattcacttacataattccgttgtattactaccttagaatggctgaatactcaaatcttgcagaaatgtcgacagttgttgatcttgattttattgaaaacaatgaacagattaaaagctccttttataaccgtctgatggctttgttgggcgcttcagcattcagtcagaataaaatgactcaagctcgtttttattgctcatacggcattaatgtaacgaatattgataggcttgtcgcttatagctatctaactttgggtaacacttatttgcttgatgattatgaaaaagcaaaagaatattacctggccggtttaaaacatactgagaataaccccttggcaaaattacagctaactagaagcctttgtttcttggaaaaccattggaatcaagagaacttttggctaaaccctgattcaaatgaagttacagatatccaagaaattgcacattatcacatcaaaaaaaacaacttgcaacaggctaaagaaatattggagaacttagagcagcaaccgaatattcataatgactttggcattcatttttatctaaaaggactagcttatgaagataagagattcttttatgagtctataaaacactttaagctgtccggcgatctatacagcgtacgcttacctttggataaattaagggaaatgggtgaggacgagcagattttggatttacttgccctttaaatcgcgcgatatcacttgaaaggaggtgaaaactatatgaaaaaagtatttatcggtcttactatcgtagcttcattggctgttggtttcgttgcaggtcaacaaacaactattcatagcgcatcaggggaaggaacattccatgtagcaggttttggacgtggtgcgtaagcattacatatccatttgaaggggtgagcgattcgttcactccttctcattacatatttttaggataaaaataaaataagtgaataaaaggagaaatgttatgacaaacgaattatcaacagagttcaaatatgatttagtcgatcaatcaacagctgaatttctgaaacagaaagaattcaacatgcgtgagattgtaggcaaggcttataccgagctaggaagagagctgaaggaagcgcaagaaatgctcgctatgaatgggtacgggtgttttgaggaatggtgtatgtctataggaattaatagaaaggcagttaataggttaatacaacgatatgaattgattgtgacaaattgtcacaatcaagaattaatagaagacctacctgtttctctaacatatgaaatagctaaaccttcatcagaatcaacagagtcaaagaaacaagctaaggaagcagtcctaaaaggtgaagtcaagacattaaaggaatacaaagagcttgaagctaagttgaggaaagctgaagaggataataagaatcttagttatgaattaagccaagaaaagaagaacaggacagttgttgaaaaagtcattgataacactgactacaaacaaatagacacattaaaaaaagaattagagtacaaaaataaaaaatatgaaaacttatcaaaacaaaaaatgatcttagagcaacaacttgaaagcagtgatgtgaaagtaaaagaatacgaggagctaacaaacaaattaaaggccgtaacaagagaacaggatgatctagggagacaagttgaggccacttcagagctttctgaaatggtttgggagattgaaaaactactaaaaggtagtttagcgcctgtaaagtatgcaaaggccattaggaatatgagtgacaatcaaattataatgaacaatcttgattctgtaatcgggcatgtggaatcctggtgcaaagaaatgagaaaaattacgaataaaaataatattattgaggtggtttaatgtgacggaagatatttttgatctacaggatgagcttaaagaggctgaaataaatttaaaagctgttgaagaaaaactagtagaccatgacattctagttctgagacgtgaggaattaaaggaacaaatcaccgaagtaaaacggttgatctctaatcatcctgacaataaaggggagagatgagcgctctgatgaattcgcataagaaacaccttgaagaaaaacaatgttccctcaaggttttgcaaaaacaaattgatgaggtatatgaattagagccaagaaatgcactcgaactcgaacgaaaaaaggttgtattgaaacgagaaattgaagacttaaaacaattgattaaaggtgaaaacagaactgtattagacattgttatcagtggaatgcttgatggacaatactacgaacatatgaaaaaagtttctggctatactgtggattacataattgatgactgtatagtcatggaatatgtagaagaaacaattacaaatgactactgggaaagagttaaggctattaagaatgaactatggaacaatatcctagaagagtcgccatacttggagagtagagaaattgatgagcatgtattttatattccagtgagaaagggatatgagggtgaagggataagaaaatttattagtgtttttcaaaatctaattggcaatgagattactctaatattcaaaaaggagagtaatagatgacagcaagaagaagtgtgcgtatcgacttagcagcatcagcaaacggatttaaacggatcagagaagataagtcgctttattataaccaaaaacataatgcaatacttagcacgaatggtcacatagcagaggttattagtcctcaaccatatgattcagtggttattgggctgccttacatattgcgtgatggtgtttgcaagaaagttacatacagaaaatcaacggaaaatttaaaaaatgacataagaataatgcttgagaacctggataaattctcatctaacggttttcatcaaatgactgttacagaacgatttgataccggtttaatcaagctatcttcttcatattgtccggaagcttacgctgatatatcgaagtttaacggtaggaatgtggagagtggggagcaactgtggtgcaaacttgaaacaaatgaaaacagagcgccgattgttacagctattgaaaacagtaagccgtcagaatacttgaatttaatttaaaaggagagaatgcttataaaaattgaggttttaacatcaggaaaaacgttcaagaattataaagtgctttgcagagaacttgggctagaagtaaaacgttcaggggatagtcgaaaagcgcagtttaaagaactagaacggtactgtacatatagcaaagttggtcattccataattatagaggaagtctttgagcagcctcttcaaaaaatgaaacggcaggggaataacactgtttatagtgaactgttacagctccttatattggatatgcttgcccaaagcaagaatggaaacatgtctataagtaaaggacgattaataaaatcagtgagcttggttaatcaaaattataagtattgctttgaaaaaagaaagtctctagctagatatgcaaacacggatacagaaattgtgaaagatttttacgatagtagcaataatagcttcaagaaagcggttgtacaagccctaaacaagttagttgagaaaaggctaatcatgtatgacgttattactaaggtttgtgaaaaggggaaattcagaccacgtaaagcgtcctcggccgagaagaaaatgattatggcatgcgagaaaaaagtgcttgatgagcttggttataaagaattaagtcatgtgcgtgtatcaaggcactggaatgaatttaaacggagatcggagactctattaaaagaatgtagcaatctcaaatattactttgctgcttatgacatcaccgcaaatgataaatacattgaaaatgagtgtgaggagctcattggttttctgttgaaagaaattgagcgggttgactataaggagaaactgaatcatacagcttgttcaaagttattgaaaaatgcggaaggtagacacaaaaagtcgtattcaatatttagagaaaacaattatagaatcagtgaaaattacattcgtgacttcaaaaagctaattgacctccttataaatgaggacgctgagagtataagcgatgaaattgaacagatggaagcccaagatgatctatcctatgatatagcgcagtctttgccaagtggtctataaaaagtaacggtttaaacttcctatagtataaacaagaaacacaataggaacattaaaccgtcaaatttttgagtttaagtattacatagaaaaaagagtgtgaaacaccagtctgaagggggtttgggggatggttggctgtaaggttaataatttggagcgtagcgagggattattaacctaaagcatcccccaagtgttctttgatcatttgaaattaagaagagcctagatgtacaaagtaaactttgtccatcttctcatcatgattaacaagttaatcattcttcggaataaacaattggaggattacttattgaaaaatgaaaatttaactaaatcagtgttcgtgtactctttagattcatctgctttttataatgataaagaagaaaaattaaatcaagatttgcttcaacttcgcctttataaaaagtttttgcagaagttggctaaaaaagtggcaaaaatgaatgattcaaatgtatccgatattcatttaaatctaactggtaagctctttgaggaagaaagaagctttaaggaattggaacaatcgctaattacatatatcaagaaaaaaggtgaaagtgagtccaggctttcgaatgatattgatgagctaatggcctgcaaatacaacaaagcgaaaatcaaccgtcttaaaaaaattactaactgttggattaacgaaaagaaagatgaattaattgaagagcaacaaagtttcaaagggacaagaacccttagaggtgattcgcttaaaacaaaagatggagaagttagatcacaaagggttatttctttatttgattcagtgctaattagaacacttggattggactacgatcagatcactgaggagattatgatagttgaatccttttaccataacgtttttagaagcttggttcagaatggttattattttaataatgaaaaatacgtttactatgcttcatcagcaggacaaattagacaaaagaagggtgtattcatcaaagaaaagacgtatctgaagaagaaaaacactctgatgtgtgggcttagtgaagaggtaattaattctaagggcggcatgagcattaacaaatggatcgcttaccttgccttatcaaatagcgccagtacattatgggaagggtttaatattgatgagtgtatagttgtaaatgattttgagacggatgtgtccactgaggttgattacataaacgatgaaacatacgaaattaaaagagagtacaagtctattccaataaatcatacggatggctgtggaatgattctccctgagctttcggagagtgcattcatgtttagagccccttttatgaaaggaatgttagtcccatttccatttgatgagtattctaaattatgccggaagaccaaaattaaagatatatacggcaaggaatgggatattgttaaagacggtattaaaattatcctaacgaagagtcagtttaagctctggaaacattatgattcatgggatgattacaaatccaaatttaagaagtatgagtgtcaggcagccaagctgaatgaagaagaggatgaatttaaaaacagtgaacttaattatcaaatgatccagacactaaccgacacgacagatgaagaattagataagctttcagaaaacacagtgaagaggatccaaacgctttacaaagataaagaatcaatgcttgaggttattggagccgttgaaagcaatgcccataaaaataactttcagaaagctcatttgatttatcctgagttgcttaatgataaccattcaaaggagattattaagaagaataaaaagcgtttggtgaaggaagcaaaagcaggaaaaattctgctagaaggctctcattatacttttattattccagatttgtatgctgcttgcggttattggttttgcggtgattctgatccaaaggttttgctaaatgacggagaggttagttgtaagctttttaataatcagcaaaaattagatgtgttgaggcctcctcatctatctagggagcatggcattaggatcaacaagttaaatgatgatcttaaagactggttcattacgaaaggcgtgtatacgtccactaaagatgccttgtcaagacttctgcagtttgatgtggacggagataaagcacttttagttagcgacagcacttttgttgagatagcagaaagaaatatgaaaaatgatgatatcgttcctctttattatgaaatgaagacagcagaaaaccaagaaatcaataacgagaacatctataaaagcttggaactggctttcgaggtaaatattggtgaatatagcaataacataaccaaggtgtggaatagtgataaggttgatttagacgtgatcaaatggcttacaatggaaaataactttgagattgattatgccaagaccttatacaaaccaacccgtcctgaacatgttagtcaaagaattaatggtttcctgaaagggacttataacaggaaagttcctcacttctttatttacgcaaaagacaagaaaagaaagaacgtcagatcaagaaatgattctgtagttaatcggttgggtgaaaaaataccgaataacagggtgaactttaagaggctggcgggagaatttgattacacaaaactgaagaatgagaatgctactcttgggcttgatcaagaggtattgacacgatttaatgaactctacaagttgtattcgaagcagcaacaggaattaggtacaaagggaattctcctgcaaataaaagatgaattactcaaagattatagcaaaaaaaaggttgaagatacaatgattgtgacagtctatacaatgcttgatcgtaataagcactggaaggccaaacaacagaaaaaacaaaatgtttctcgtcaagaagcagaatggcatgtaacaaaagagatcagagaaaccttgctgagtattagagacagcagttacataacagatatattggtggagtatctattcaatactaaatgctctaagcataaggatacactatacaattgttttgggtataacattgtaaggaatttgaaaaagaacattcgcagagctattaaatgtgttgattgtgagcgggaaatcgaaaagggaactaggtgtgataagtgtcaaaaggatagggaaagagagttaaataagctgagaaaacgaaaagaacgtaaaaataaaaaatgtcacgcttaaattacaagaaaataaatgaagatggataagcccttgatatacaagggtttttccagttgtatagtgatatctataatcttcttctagggaagaaaaaagaagtattgatttatggataattatttatacggttccgttattataatttatcacaaaaatccatactatgcaatttcgacccaaacattgtttaattcaactttggacatctatagtcttttggttattcctcctaaataatcaaagaatgctgatcactatgatcagccccccttattttagataattatttcaaataaaaatttattgatggaaggaggactataagtggaaattgatagacataagctatggctagatattcgcaaaagaaggttaactcaaacggaaattgcgaaagaatgcggttgtgctcagtcaaaaatcagctcctttttgaattatgattcagatatgtcacctgagcttattcaaagaatgaaagactttgtctactctaagcctgagtatgaaaacggaaagcgtagagtaatcaaagtgatctaattctttgtcgttactacattaaacagcattgcggaaacaatgttgaagagatgtacaagccgactccagcgacgttaaataaatggtttcggggtttcattagttttactcctttgattttatttttattcttattccgagccattttggttcggggtttctccttttgacatgactatgtgcggggcatcctcagtgcccccgtaatcgtgtttaaatgagaaaaaacaattggaggaataataaaatgaaagaaaataaggttactgatacgaaaatcctcaagtcaggatattactgtaagaaatgcgatttgttttttgagaatacatgggatatggaatgctactgtcaaggcgaaggatggtatagagctagtaaagcgattttgatgttagagaaggtgctcggtaatggaaaataaaaaagaacaaccaagatggggcgagccaaatgagaagtttcaagagttggttaaaaatattgatccagaagtattaagaaaagcgaatgaaaaaataaaagagatggccaatggtaagcctctttatagattttaattaaacatttaggaaggaggtgatgatatgagcaaattagcaaatgacttaataggcattttcaagctcgtttcaagagacagtgagttaatgaatcttgcttattataaagagttgagtaatccagctaatatagatgtgcagcaaagagatgattttgatgacatcctcaaaggaattattgttagagctcctaaatctaacgatttaaaagaagatgatcctcaatgtcggatctgcatgtactttggtaacggctatactacacacaataagcgtattacttcccaggatgtaatgattgacgtatacacccatattgatcattttgaagacaatgatcctagaagtctcaagatcatagaccggctaattgatattgtttacgataaaaatgttgctggtgtgggtaaggttgctaatatcaatagaatgttgatagctaatccccctgatggatacctcggctataaactcatcttttcctttggagctccacaataatggaatattcaaaggacttctttattttaggtactcctatttcaacagatataggagagtgccacttcattagacttaaagattatcctcagttcgtaaatgatctctctcaaatggttaaatcaaaatctgaaataatagctgaatttcaagaaaacaataaatttggtcaattggatagcttgatcaatgattttaacgcttcaactttgttggacatagttaatgtgatggatcagttaagagcctcttaccaaagagtgtttgcgaaggtgtttaataaccctgatgcattccaagctgtagacgagaagaacttttacgatatccgcaagttaattcttgatatgcattgtttaaaagaaaaaaaggttagcaaaaactctgaacttgaaaaattcaacaagaaaagtagagcgttgaaacagtctgagaacaattatgatttctccgatattgttagttgtgttgttcaatttactgggtattcatccgctgaagttcttgaattaacgcttccccaacttcactctcattttttcagaggcgctgcttttttaaatagctctgctgcgattgtactctctactgtaagtccggaagctgccaaaaacattggttcttggagtcaacatatagatttatttgaagaagagaaaaattacataactaagaaagaagcaagaaacttagagaaattattctcaaattaaaaaacaaggtggaattttaataaatgagtaaaaagacagtaattcatgatgtatgtaacgttgttatgaaaagaaaatctgacgggaaagttattgcaactgctgaagcacaaacaactagcctgtctcaaagtatccaggaagactatttaaaaggcggatggggaaaccaaaacctttatcaaattaagtccgacaagaatattacaggaacaatcaaaaatgctttcttcagcttggattggttggccatgcaacaaggagtcaaggttgaaaatgggacggtgcaagtatgggaggatgagacgcttactgttgagacagatggaaaagtaactcttagcaagactccagttgatgcagtttctttcgagaatagcgaaggagagtcttatcttatggaaactgaatccacagaaggtcaactccctacaacttttgcaaaagagggtgcgaaagttaaagcacgatataaaattgatgctgaaggtgaaattgttgaaattaaggctgatacattctctgaagcttatgagatggaatatcacactttagagtacgatccagaaactgaaacaatccatagtgatctttatattcagttcgataaaatctctccttctggtgaagcagagctaaactttgaagccggcaacgcaattacacctgaaatcaaattcacagcgcttgcagttgataattctcttgggcgtttcattcgggttaaacgtaaagcagacggatcaaaaggtgagaaacctactgagtctccaaagcaaagcgttgatcttggcggcgcaagtgcataagggaggcgttgaagattcctttcttaaataaagatggaactacgcttacctctgcaaaagatgatggtactggcaaccctataacgcctgtatcaattgaaaattcaactattccattagaggttgatcttaaaactgatcagcctcttgatgttaatgttgcaaacaaatcatctattccagttcttgtgagaaacacagttcctattaaaactcagatccaaaagtcatacgaggaatctgtgttaacagataatgatactgtggcagttggtgcaacaaaatcgtacacattagatcttgttgagaatttaggagtgtttagaacttatggcgttgctctgtatacaacacagactgacagcgcaaatagcaaagttacagttagtgcttattcagtaccgaagagcattcctttttattcatcaacatcagcaagtgacagcacaactttaatcagtaatgctgcatttgtttcaaactatccaattcaaaaacagttgcccttcatttgtccaaaattgctattgacagttaaggcatctggaacagttgatattactggttttaaaatgattgtttgggggatggaataatgacttttcatgatgtatgcggaaagtttaaaaaggttgatggtattgaagatgcatatttactgctttcagaggaggacaattattacataagcctgagtgattttgaaaagctctttgaagaggattttgacgaagagcatccatatgaatcactttcagcagcttctgataattctccagcctggaaagacatttgggacgatatttggacggaagacctttaataaggtcttctttatttttaaaaggaggaattaaatgaaatcgaaaaaattaagcgtatcaggtgtaaagacactatcaaaaagtgttgataagaaacaaaaggttcagataaatgatgagtatcatgtatacatctatcctcagttcggtatgttcaagttacaaaagatgtttgagaattttgtgaaatctctattagaagctgaagagcaaggtattgacttgagtaagatcagcatgaatgattggttaagttttaatgtcgtgaaggagttcagtgacttggatatccctgatgatactaagaaacagtttgagttttattacgagttaatgaacactgatctcctttatccaatctttaataagtttcctatagaatcacttgaaaaaataaacatcatagctaatagacttcgatccaattttgaaaaattaggatctgctaagtctgaagagtttgaacagatgattattaatacagtagctgaactagaagaaaaataaaaaataaccattcaatttaatcaaagtcgattcgcgaacgactataaatgtataaacaaggacagaaaacaacatgcaggatatattagcaccctccttccatgctagaaaaaagtgataaataaggataaaaataaaataaatagattgacgatagtaaacgtaagtgttataattaagttaagaaaggaggggaaatgagtatggaaaagttagagcttatccttcgggacttggcttgggtggttgcaatcctagcaggaataacaaccatgatcaagaacatcaaggacttgaaggcaagcaaaaacaaaaaacgacgttctcccgccaagaagaaacgtcgctcataagctagaggggatttattccccttctcttattattataacacttttcattccatactcaaaacacatgaaaaaattggttgatgtcacaacaatattcttttttattctgttcattatgctgttttcgaattttgattatgctcatcttagcaccttagatatactaacaatggtattagcgttaatctggttggtagttactatcataaacattatccttaagtggaggaaccttagaaatgactaagattgtttttgacagcattgatgacttaaaagattttatagcaaaagaaattttaactacatctgaagcgattgagatcatcggctgtagtcgtcaaaacttaaaacagttggtcgatcgtgaaacattagtacccattaaaacaacaagtcgggatcgtttatttttaagagaagatattgaaagttataaaaggaaaaggtaaaggcatccgcagcaacgggtgcttttttatttgtgttatggtcacaagagaaatgtaaaaaataaagtaggtgtaaagcaattatgctgaacgaaaaaaagataaaagctattggattaattgctgaaggaaacctcagtatgactgaaatagcaaaggaagttggcgttagtcgaaatgctctgtatctatggagaaaggataaagaatatcagcaggagctagacaaagagatacaaaatttcaaacttttagcgcaacaagaaagaaacgcaagggccaagaactggtttaaaaaattagaatacatcgccatggatgatgaccaaaagactaaggatcagatagatgcgcttaaaacattacttgcttactctgagggaactccaacgtctaaggttgaaatcactgagacaaaggcaaatgaagtggataaagaaacaattgaagatgagattaagatgtggaaacaatcaaaagaagacaaataaaaagccctctcctatgtcatttagaaggggcttgtaacttcttcttagctcttattagagtgcttttactgatacctgtaatatcctcaacttgtttgtatgaatgatcgttaagtaactctaaggcgtgttgtatttgcttcttcgaatacttgttaggtctaccctctcggaagtcttcacgttgctttgcaatggcttttccttcctgagtacgttcgacaatcatatctctttcaaactctgcaaacccactcataatggttaatattagccttcctgttggtgtgtcttcaactaaacccatgtttaatacatgaaccttcacaccctttgaaaacaattccttgactgtattaattgcatctacagttgatcttgcaaagcggtctagcttagtaacaaccaaagtatctccttcttcaagctttgataaaacctctttgaatttagggcgatcagctttagtacctgtgaatttttctgaatagatcacatcgcatccttggttctctaatgtggctatctgtgattccaaatcctgtgaaactgtacttacacgagcatatccatatttcataataaagcactccttttgtgtatctatttatggaactaagttatgacacctcttgataccttaattctacagggttcaaaggatggtgtcaatacttttaagatatgacaccgatgaagatatgaaacatgcttaaatttgtatgtaagataagaaattgcaggctgatttaagcatgtttaaaggggctgtgtgaagagttaatgagttagataccaatagtattcaagctcattaaagttgcttaggatggctcacagtaaggcataccccccaccattctgtttttaaaaatgctgtcttatccgatagcagggtacaaattttttgtagtatttttcaaatttccgaggtgataaaaataagtgagcaaataaatatcaacacgtcagagaatagacgttttctatatgaatatttagttaaacaagcagttaaagagcatgatctatctgaatcagatgctgaagagtttgcagcgcatttaatgaaaaaacgatcagatgatttatttacatatcatggtttggcttgggaactagggcagaaaaaccttgagttcttttgtctattcttccttcaagacacatttagagcacctggtacatctgaaatagctcctattcataagcaaatatgggaagacattgagaatatgctcctacataacacacatgataagcaagtgtacgtccttcctaggggtactggtaagagtgcattcgcaaacttgcctactgtagctttttcagttgctaataagctaagaatttttacgcttgtttgttcctctacaggtgagcttgcggataaattcataaaacagatcaaggaagtatttgttgacaacatctatctccaatcttgttatggaaagcttttggatccatctaataaaaaatatatttgcaactcctctcagctggagtttacaaatggaactatggttgaaagtatcagtagtaaaactgatatgagaggaaggaaacaccctgacaatacaaggattgaattagctatcctagacgattatcaaaataatgatgactgcgctacagatgcaaacagagagaaaaaatggagacgttttgcaactgatgttaactttgcactacaaaagcctgtatatgataaagatggaaagttaatcaggcagggtggaatcatggtaggatgtgggacaattcagcacccagaatgcttttatagcaggttacttaaattgccaacttggagatcacgaaaagaaaaaggcatactcgttgatgacattgatgaaatgttcagctctggattgtgggctgaatttaaagaaatcctttcagattccaaaaatgagaacaggcttcttcatgcaaaggaattttattatcaacatgaggatgaaatgaaattccctattctatgggagagttattggaatcctttagacatggcacttgcttattatgaagaccctgtggcatacaaccaagaggtacaaggtttaattacctcaacaggacaaaagaaattcaaaacaattatcactgagtctgctgaaaagattgagagccatgactttacaaaaacaatgctgtctattgatccagctgggacaagaaataaacaaaagaagaaaaaggactattatgcttttgtagttggaagtgtgtcagacatgaatatcaagtatgttcgtaaaggtacagtgtttaagggtgagtatgaggattatatggattatactctcaagctccttaaagaatatcctgatatcagttttgtaaacattgagaaaaacgtttataacggtgcggatgttattcagcttcaagagttagtaaggaatgacccccaattaaaaggcagaaaaattgagtggctcaataatgctgtaaccaaaaataaggatgacagaatcaataccattgttggtgatgtcaatatgggaagaattatctttaatgaagaggatgaggaagcgatacagcaacttagagattttgctggtgcggatttctcagcatacgatgacttccctgatgcagtagctgaatggtctaaaaggataaatgaagttgaagtaattaatatctcgtcaattccaaggaattggcttttttagattgaggtgaatttatgaaaaatgaacaattgataactaaaatgcttgaccacctaagattaaatcaagggcatcatgaaaagttaaagcgatattacttaggtgatcacgatattttgcatagtaaaacagcaaaagatcctcttaaagcagacatgagagcttattttaattattgccgcaagatggttcagaatagcgtgggctatttgttaggtaagccggttaattatggatcaaaaacagagaataaagagtttattagcaacattgattattactttagcaattgggaacatgcccataatatcaagttgaaaattgaggcatccattcatgggtatgcttatgaagcgaattacataaacagtgagggtgattttgagtgtgctgcatattcaccacttgaaatgatcgttcttcatgatgggacaattgaaaataaagtttcgatggccattaggaaatacaaagttcaatttgatgagactgagtatgtagaagtgtgggacgatacgttttatagcaactataaattgagtggtgggaagttgttgctcttagagcaaaaacgacacagattctctagatgccctgttagagagctcaagaacaacgatattaaaaaatctacatttgaggacattatcaagattattgacatgtacaatgctatacatgccaatgcggccaatgaacttgttgatcatagaaattcttatttagttttcacaaactgcagcgttgaatttgaagacgccaaaaagatgaaagaaaacggcatcattatactccctcatgaaaaagcggaggtaaagtggcttactaaagacttacatggaacctttgtgaaagatatgcttaaacaatggcaagatgaaatgtatatacaaagtaatcaagtaaacctcaatgaaaacttccaaagcaatacctcaggtgtatccatccgtttaaaacttcaagagttagaaaaccaatcagctattgcagaatcccactttgaaaaagttcttaaggacagactaaagttcttttgtgaatttctatctctcaagaaacaagccgaatttgattataaagatgtcaatgtagcattcactcgaaatgtaccggtagatgaagttgctatcgctcagatggtatcaactttgagcgggttagttccccatgaagatctcctttcaaggctgcctttcattcaaaatccttctgcttcaatgcaaaagttaatcaaacagcatgagacggtgaagttgcacagcgccaataatatgaacacaacagcagtacctaaacaggacatttctgatgaagaggatcaagaacgcctctcaaatggactgtaaaacaatatgggaatcttgtaaaaggtcagggcaagatatgtgtaaatgtgggttaattacacaaatacaacactctatggcgtgtacatagagggttaggaggaaatatggatttaaaaactgttaaagaatttttagagcaaaacaaagaaaaggaagaagttaaatcatatttagaagaactgtctgccgtatctgctgataaggtgtcagggtttttagatactgatgaaggcaagaaaattttgcagccacgattagatgaacatttctcaaagagtcttaatacgtggaaaaccaataatctgcagaaacatgttgatgaaaaggttaaagagttatacccagaaaaagatccactggaattaaaagtagctaatttagaaaagcaattggccatgaaagaaatgcgctcttttgcaatggataaagcgcataaagagggattacctttagaattagtggatcttgtaatgggtgaagatcaggagaagactagttctaatttagatcttttaaaaggcgtgttttcccaacatattgagaataaaacacaagaaagattaaaagccgatggcattgatcctaaaggttcacaagaaccaccgaagacattcacaatggagcaacttaagaacatgtctgaagaagaatatattaaaaatcaagaagcggttgacgcttatcttaatagtcaatccaactaatttaattacataaggataaggtgataatatgtcagttcaaaatttcattccaacagtatggtcaacaaaattaaatcaagcttatgataaagcgatggtatacggtaatctcgtaaatagtgattatcaaggcgatgtgagttacgggaatacagttaaaatcaatacttttggtgaaatcacaatcggtgattacggtaaaaatggtgtaggggatcctcaggagcttgattctagtcaaacagaattacttattgatcagaaaaaattcttcaattttaaagttgaagatgtggatgctgctcaagctaatatcaatttgctaaatggcgcaatgaatcgtgctgcatatggattagcagatactgcagatcggtttattgcaaatctatatactgaagtagattctaaaaatgtaatgggctcagatacagacccaattcaattaaccaaactagatacttatgatattttggtcgatttaaacaccaaactttcagaagcaaatgttcctaaatctgaacgttatgcggtagtaccagaatttgcttatgggttactgcaaaaagatgaccggtttacaaaattccaagaaattcttttaaatggatacatcggtaacgttggtgggctacaaatctatacatctaataacgttcctgtaattgatggtaagtataagattatggctggtcatagatcggcaattacctttgcgtctcagcttaacaaattggaagcgtaccgcccagagaaatactttgctgatgctattaaaggcctccaagtatatggcgcaaaagttattaaaccaactggaattgcggtcttaactgcatctaaataataaaaattgagggcggaggctaatatctctgcccttttttatcttaataaggaggaattaaatgtttgtattaaataaaaaaacagggctcacttggaatgttgaaggtgagttattagaaaggcttttaaagtcgccaaattatgaaattgttgaatcaaaagaaaaaccagtaagaaaacctcggccaaagaagggttcagaataatggataaaacaataaccctaaaaatcctcttagatattgatcgagacgataccagcaatgatgaaatattgagcctgtacttattaagtgcagaaaattttataaagaactattgtgacgttgaaagcgttccaagtgagttggatattgtgcatttacatatcgctgtttttcagtatcgtcaaaatgggtttgaagctgttactgctgagaagataggtaacattagtcagacttttaagagctcaatgccaaaccatattatcgaagaattagataaattcattagaaatacaaaatacgtgaagtttttttaaggtgacaataatgaaatacaaagacctttattatttaattcaggttaaaagggtgaagacaggcaaaaagactgattggggaacagacatatatgaggatcaagaaactctagttccatacaaatgttcttttcagccttatgttgaatcaattagttctccaactgcggtaggaagaataactgacataaccaatatgatcttctgcccgcctaatgaaaagctagagaaaggcgttaaagtcgttcataaaggaaaagaatacgaggttctttacccacccagagactggggaagacattatgaggtgttcgttaactatataggcgcacacaagtccactaagtaaacaaacgaagtgctttaaattttgaggcacttcttttttttatttgtagaaaaattactaaggaagtgaaagaacaagtgtctcaaaatttaaaaattgtattaactcctgtggctgacacatcaactaagacagttcagcaattaaataaagatatatccacacttcaaaataaaatcaatccattgaatctcaaagtaagctttgacgacaaagttcttagaacgcttgagaggttttcaaatgcttttaagcaaagtgaagaggcgttaaaacaccttaatcagacagtcaaagaaaatattactgagactaaaaatgcagatggttctatcactaggcttacacagcagtataagcggagtggtgaaatccatgagaaaactcggacaatcatagacaactcaacaaagagtttggaacgggaatcaaaagcagcaagtaagctcgtacagcaaatggagcgtcttggccaagctcaaaagaaagtaacgaaacaagatgcaactggtcgtgtcactggaacagtgactaaatatagagatgagtttaaagatgttacccatagcacagatagacacggggcaactttagctgttaaaaccacagaaaactttgaccagcaacaaaaggcaatagataaactaaaccaaaaattagagcagcttagacaaaaaggccaactatcctcaacagtcctcaatagactatccagttcaattaacgccgcaagaacaacctctcaaatagatcagatcgctaacagaatgaaacgcttggatgactctgcagcattaaaagctagaactaaagagttagaacatcaattaagcctgtatcagagacaagctaaattaaatgttaaatctttgacggataggtatggaacatctatcagtcctgagaactccagagcattgcaaaactatattaattctgtgaatcagctcaatgtaaagacaccaaatattactaggcagatgcaaagtcttagtatgcagtttagagagattcaatctaatgcaagctcatcttcaagacaagtatctagttttggtgagaaattaaaacaagcttttacaggaatgcctgcttacatgctagccggttctgctttatttggtggggttactgctcttaaatcaatagtttctcaggttgttgaaattgatacgctcatgacaaacattcgtcgtgtaatggatgcaccagactacaaatttaatgagcttcttcaaacgtccattgaattaggggattccctatcaaataaaatctcagatattcttcaaatgactggtgattttggacgtatgggttttgatgaaagtgaactctccactttaacaaaaactgcacaagtccttcagaacgtctccgatttgaccccagatgacactgtaaatacattaactgccgcaatgctgaatttcaatatcgccgccaacgattctatctcaatcgcagataagcttaatgaagtcgataacaactatgctgtaactacaatggatctggctaacagtattagaaaagcaggttcaacagcttcaacatttggtgttgaattgaatgatttaattggatacaccactgccatcgcaagtaccactcgtgaatctgggaatgtggttggtaactcattaaagacgatttttgcacgtatcgggaataacgaaagctcaattaaagctttagaccagatcggaatttctgtaaagactgctggtggagaagctaagtcagcaagcgagctgattaatgaggtagcagccaaatgggatacgttaactgatgcccaaaaacaaaatacctctattggcgttgcaaacatccatcaattgtctcgatttaatgccttaatgaacaacttttccatatcacaaaacgcagccaccactgcggctaattccacagggagtgcctggagcgagcaacagaaatacgcagatagcttacaagcaagattaaataaacttcaaaataagttcactgaattagctgtagcttcaggagatgcatttataagtgatggtttaattaatgctgtatctgtagttggggatcttctgaaagctgtcacttcagctgtaaagggtatcggattccttccaattgcttttatgacagcaaactttgctttagttggctttaataagaatatgcgtctgcttcaaacagcaatgatttttggggcgaattctttaactgaagcccaaagagcaacaattgggatagaagcgggaatgacaagagctacaattgctacaaggtcatttactgttgcttggagaggtatgttggcatctacagtagtaggtgttgcctttgctggtataggttttgctttagaaaaaataattacagcattcgctgatgcaaagaaagcaaaagaagactttgaacaaaatcagcaaaccaatgttgaagcaattacaaccaacaaagactcgacagacaaattgatcaaacagtataaggagcttcaaaaagctaaagattccagaacccttacttctgatgaagaacaggaataccttcaggttacacaacaattagcacaatcgtttccggctttaattaaaggctatgattctcaaggtaatgcaattctaaagagtaataaggctttagaagaggctattaagaataccaaagaatatcttgagctcaaaaagacagagacaaaagacggtgctaaaaagacgttcgaagacgcttcaaaaggaatcgaaaagtctaaggaagaactgaagcagtatgagaagatggccaaggaatattcaaaaggaaagaatttctggtctttctttgaaagtcctttttcagatgaaaatgattataagttggaagctgataaagcacagctgaatataaatcgggtacaaaaggatatctctagcggtaatgcaaaagttagggacagcgtactatccattgccgaagcttacagtaaaattgatattagtaatacgttaaaggcaagtatcaatgacattgtaggtaaactcactttaaaagataatttgaatcctgatgatctcgataaattctcttcagcactgggtaaactccaagagaaaatgcaatcagcgttgaattcaaatgatgaaaaagcatttgataacgcaaaaaaagacctgcaaacccttttagagacctatgctgactctggttcatcaattgatgtctttaagttgagctttgataaggcacaaaagaacattaaagatggcgacaaagccgtttcttctgttaaatcagaagttggtgatttaggtgaaacacttgctgaggcaggtaatgaagctgaagattttagtcaaaaactaaaaaaagcgcttgatacaaatgatatcaatcagattaaggatcttattaaagaactctcagaaggaataaaatttggctctgttcaagatatccttaatggagatgtttttaataacaccaaagaacaagttgcgcctttaaatgagcttttagaaaagatggctgaaggaaagagcatttctgccaatgaagctaatgctctaatccaaaaagataaagaattagccaaagcaataagttatgaaaatggtgttataaaggttaaccgagatgaagtaattcgtcagcgaaaagttaaacttgatgcgtatgatgacatggttcgatatagcaatcacctaatgaaaaccgaggttaacaacgctattaagaccttaaacgctgatacgttaaggattgacagccttagaaagctacgaagagagcgtaaacttgatatatccgaagcagaattgtctcagctcgaagttaaatcaattaataatgtagctgatgcgaagaaagaattacataagattgaagaaaaaatgttgcaacctggtggattttctaacagccaaatctctgcaatggatagcgttagagctgctcttaaatcctacatctcagcatctgaagaagctacatctactcaggaaacaaacaaacaagcgttaattgaatctggaacttcccttgaaaaatggacagacgagcaagagaaagctaatgaagaaaccaaaacatctacttatgtaactgataagtataaagaggctttagaaaaggtatcatctgtaattgacgaacaaaacaagaagttaaacgactatgcaaaatggtctcaaaaatacagaaataacctaaagaaagaaatcaaagaactccaacaaaagaaaaagcttatgcaggagcaagccaaactcctcaaggatcaaattaagtcagggaacattacacaatacggtattgttacctcttccctttcctctggatcatcttccggtggttcttattcttccggtggcgggtcttactccggtaaatactccagctacattaattctgccgcaagcaaatacggtgttgatccagctctaattgcagctgtaatccaacaagaatcaggattcaatgcaagagctcgttctggagccggagctgctggtttgatgcagctgatgccatccacagctaagagtttaggtgtaaacaatgtttatgatccttatcagagcattatgggtggcacgaaatatttagcccaacaactaagcaaatttggtggcaatgtagagaaagcacttgctgcttataacgcagggcctggtaatgtaattaaatatggtggagtccctcccttcaaagaaacacagaattatgttcagaagatcatgtcaaattacaccaagtcaatgacttctgctaattcctctattgcaagctactacacgaagaacagtgcgtttagaataagttctaagtatggtgcacaagatggcgcttaccgatcaactccacataaaggtatcgacttcgcagcaaaagctggaaccgcaattaaatcggttcagagtggaaaagtccaaattgctggttatagtaaaactgccggtaactgggttgtcattcagcaggatgatggaaaagttgctaagtatatgcatatgcttgataccccttctgttaaagccggtcaaactgttaaagctggacagaccatcggtaaagttggcagtacgggtaattcaacaggaaatcaccttcatcttcaaattgaggaaaacggaaagacggttgaccctgagaagtatttaaaaggtgtcggtacatctatttcagatgcatctcaagctgaagcagaacgacagcaagcaatagcgcaagctaaatccgacctcctctccctccaaggtgatatcagttctgttggagaacaaatagaagagcttcaatacgaaattgtgcagtcaaagcttgatgagtttgataagcgtattggtgattttgatttagcaattgccaagaaccaagccttagcaagtcattatctgtcagacagtaaacagtttagaaagtatactgcagaacagaaaaaagcaatgactgaacagcaaaagattcagagtcaaaaggtttcatggatacaaaaagaaatttcagccaataaaaatttgaattctgcccaaaaagctcaacttaaagaagagctgaagcaagctaaaatagaccttatcaactttcaagagcaagtaagggaattgcaagggcaaatagttcaatctaaagtagatgaaactttaaagtcaatacaaaaatcatcaaacaagactgaatccaagatcaaagacgttgacaataaaatatcaatgactgaaaaagacaaggattagtcagcaagtcaaattagtacagcaacaacaggctgaggccaaaaaatacatcaagcaattagaggaacagaaaaaagcagcaaagggatttccggaaatacaagagcagattacgaatgagatcgaaaattggaaagataagcagaaagattttaatctggagctttataacaccaagaagtcgatcaaggacatctataaatcccttgctgatgaagttgtctccatctacaaagagatgtacgaaaagatgcgtgatattgaattaaaagcgcatcaaaaagctacgcaagacttgattgatgagattgataaaactgatgatgaagctaaataccaaaaagagctcaaagaaaagaatcaggctattcaggaaaccaaagataaactaaacaaactatcccttaatgactctgatgaagcaaaatcacaggttagagacttggaaaagcaactacaagaacagcaagaagcattagatgaatttcttaaagatcgtagcaatacgaaacgtaaggaagcacttcaagaccaacttgaaaaagatcaggatgccataaatgacaagtatgataacctgacaaatgatgagagagagttcaagaaaattgaagacaaactcatgaacggtaaaatcactgacatctccaagcagcttaatgaattctctaaattcattaacagcaatatggagtccatcggtaagagtatttctaataacctgattgacaagcttaaagaagcttctaatgccttaaataccgttgtcaaaggcaataccaccggtcaaaaggttgctaggtttaaaactggagggcatgtaggtaagctaccagcggcgggtgctctcgcagtagtggatagcggagaactcatcttaaatgagtcagacaccaaaaacatgcttaaagcagtagacactgtacgtgaattgtcggaaaaagatttaaatggtgccccttctgcaaagcctgatttaagtaagtataaagatttccttagtgatgtttcgtttgctggtggtaagtttggaataccaagtttaagtgcgaacgttaaaacaaacgttccagattctcttgttagcaacaaaacagagacttctacagtaaacaacgactttaactttacagtaaccattaaagaaactgggaatcctcagaaagctgttgatttaatgtacaagcaatttacaaatggcctcaaaaacaaggggttaaatttcaacaactcatgagccagtatacatgctggctctatataaagcaggaaacgcaactgttaaaaattatgtaaagctcgaattttcaattacagaagtcagcaatgcaaaagagacagcgaatatggtgttcaagtaaatcacaaatagtccgaaaaaaaggacttaattttaatattgggtaacagtggtgtacttccagttcatttttcgagtgggaagtacacccttttttgtcaagccatacttttgccacttataagtgagggtttaagagctttttggagcattaactgcataaaacaagcataagatagcaaaaataggggaaaagggtactgagaagtggaaaaaacttgtttatgatgcctgattgtattacacttattgtacattcaccgaacgcacaatgtgattgtataataagcaatcatttttgtgaggtgtttagatggatcggaaaaaggaggatgagaatatggctattaatcatatgacaattcctaaaactcaatctgaggcaatgaagaacattaggcgtattatgcaaaataagatgaaggaaaatcgaatttcttaccaacaagtagtgagatctatcgaagatgcgaagaatgggagataaaattgtagcagatacatgcgtttttatagagagtatatttggtgctgaaggaaatgatagcgaaatattttttgcaagccttgagcataacgatgcaaggcttgttttttcgagagaaattattggtgaattaatgtatattttaaaaaagaagtgtaatgacttttctctatcggaagaagaaactaaagaagtgttggataatataactgcaatgttccaactgggcaaatctgtgaacactaagtttatgagagttaaagttccaagagtaaaagatcctgaagaccaaatgttcgtaatagctgcgtatgctgctgatgcgtcacatttagtaactttagataaaaaaagcggaatgttagatttgaagcatgtcccttttatttgttgcacacccggtgaatatactaataataatgatgagcagattatctcttgaaagttctacataacacagaagaagactaccgaactggatcgatggtctttttgtgttttatgaaactgctaagtgtgatccacctataagtatgcagttatggtatgaagttatagttgaaatgtaatgacaagcctccctggtaatttaacatacagaattattaaacgaacttgggtttataacaggcttacatctgggaagcatataggcatgtacaataaacaggcgtatccttattggatacgtcttttttttgttggaatagcgagtgaaataaccgataataagtaaagatgggaaggggaggttaatttgtcaaaaaagaagatcatacttctaatatcaacacttagtgttgtggtagttggtattattctagctataacaattccgatgtacataaacagattggacaccagtaatttagacacaattgctgagaaagtgggaaatgataagggagttaagaaaaactttaatcaggtgtggatgtctaaaaccgataaatctaatgataaagtatatgacttagttttagcagccaagccatctttcacccagttatcggataaagaaaagttacttacagtgggtgaagtaatggaaattacgcagaaaaactccaacttgaataaaatagactgtgggaaagacaaggtttgttcgatagctcatatttttgttcacccggataaacacgataaggtacttagatatgaagttgattatgatccattaaatacccctgaagaaaacactttactaataaaagatcgtgtagatgataatcctgaatcaactggtttccaaagaagagaagttacatacagcgaaaatgatgatgaacagtctgaagatgaagaatatcaggaaaagaaaattgctattggcatgaccaagcaggaagttatccaacttaaagattggggcaggcctatgtctattcataagacaacgacagcatcaggaataaacgaacaatgggtttacggcagcagatacctatatttcgataatggagtattaacaacaatacaagaataaaacagctctatccttaaccggatagggctttttctttcggacatttgagcctaatctaaacatagaccacacaataaataaacccctcacaaataactgtgaaggggtttatttaatactcacatactttatcttcgcactcaggcttctcggttgcatccacagtgaaagatatgactttgtcattacctttatcatagattccccatatttcttttttcttatttccattaaggtaaccgttgatttcaataccgcccattggattaatctcataatcatcagtgtaatcaatttgttcaatatctttatagtttgttttaataaagtcagtcattctttttttagccaaagagtacaactcttccttttgctgagtttcttgggcttccatttttttgtcgtgttgttccttcataaatatccctccaagtgttataataaccagagctataaggataattatgtattttttcataaaaccatcctttctgtcttacattttacatgagtgaaggggtattgtacatgaatacaaagactgacatacctaatttatcagatgaagactatttttctcttagtcaaaatacatacagtgaaaagaaaatgaaaaaagcctatgagaataagacaccacttgtaaatgattcaaaaaaggctttttacgtagataaaatcaaaaaagatccagatacagggctagatgtatacgtctttgttcaagccaagaaaaaagaaggtaaatgggtaaaaccaaaagaaccagaaaatgttgttgtaggttttcaaggaacaaaccaggaacaaattaaagctgacgttataagtgcagatggcggcaacgtagtaatgggtaaagacccgaaaaagaaagtccaatacataatgaaaaaagatgcatctgaaaactctaaagctattgccaagtataacggcagtatggaacaagcaatgatgattaagagcggagaatacaaaattgtcactaagacatctcaatttgatcaaggtgataagattgttgccaatgaagtgaaaaagtatgctggcactaacacagtgatttcgacaacaggtcactcacttggaggggcagatgcggaatacgctggtgtaaacaatagcgtttacagtgtagcttttaacaacccttccattgttaagctgcatgatgatgaaacacaaaagaaaatcagaaatggcgaatttgatttgtatcataaagcaatcattaatcctgatgatatggtgggttcaggttggtttttagaatacgacagacacaacggaacaacgatatacacgaaagacccaagcatcgcacgtcaagatcgcgctaaccggctcaatacatctttgggcattactggtattttaggaagtcttattacttcattctatggccaagcattcgctaaaaatcctgatactcatagtatgattgacgctaactttaaatttgataagaatggtaatatccagagtgtcgatggcagcaacggtgtttataaccagaatatcgaatcgttctcatcttattcaggtatgaatgggcaaaccattaaagtggatgctaagtatgcaaaagaactggctaaacgattacaggcagctatcgaagacttaaaaacaaagaaacaagcaattgaacgattccctcatgatcacagcaaaatggtttatgacgtaaaatctatttgcggaaagagattaggagaatttaaggatctagatccaagcgatgttgataaagctgtattgtttcacgcaccttatgtgaaagatggggcaacattttatgactcagaagaacattatcagactgaggcttctcttcattatttaattagagatttagaggatattagtgagttcattgttaaaatggctgaagatctaaaagataaggatgatgaattagcaagctggttacggttgtaaggggggatttaaattgccatatggagttaatatggatgcagatgagttttacagacggttacaacagaatgaggaattaaaaaaaattgtgggttcaagtttaaaatctcattgtcagagcctaaaagaagacataaaaaacgcatcagacttttcttcagcacaacaggttatagctgaagtgtatattgctttactctcttcatttgaaggtaaagctaaagaagcattagtacaaaggcttaatgaaaatgcaacaatgcttaccaatgccactgagaacagaagtgcttttctgagaagtattaagactaaatagttaaaataaccccttcacaaattgtgaggggcttttttattgtcatttgtggcaatcagtttttcaatcgactttcaacatcaaataatcgcttattcaatagctctgttttattatctacgttctgtatgtgtttaaggtgagccgtaatatcttttggctggttctcttcaaggcggtctaacttaacattaatctgattgaattccttctttgtatcttctctgaattcattcatttcctctttaaattcgtgcatctcttttttaaatgacttcaaatcagaagccacgccatcaattttgttatcaattttcttaatctcatctaatatcgcttgaagcatgttgttttccatcccgttcacctctccgtacagtataacagcaatcgcaatacttttgattgtccacattatggacaatcgaatatttcaatggttttgtttaacgaatttgaaaaaaataaaagcaatacttttgcttaagactctgtatcttcaacctcaattaattcaacaacatcgtgtaagtcacactcaagatattcacaaatctttattattgctgaaagggacacaggctcacctttagacattttagccaaagttgcagatgaaacgtctacatggcttctaaggtcaactttttttaaatcctttttgataagagtaatctccattggtttataacttggtcttaatttcataaagcacctcaaacgtccattttcttaattataacatattatttgtcaatctgtttatttttagaacattttcttcaataaacgcttgactttgttttttaatagaactatactatgtttagaaacaaaacaataaattaataaaagaaacaaataatcaaattaataaactgaaggtgaaaaaatgaaacacataattatccgtagaagtgatttgggtgactttccagcaatgttgttttacaagcatttcgccgtttctggcgaagatggtcaagtacatttgtatcaagttcttaaaaggaaggatgggaaatacgacagcatccattcagttttcttggccgaagacatcaaatacaaaaacctcagaagcttaacaaatgcagtaattgataagttgctcagcacacgattatgggatgctctcattgacaatagggagcttgttacaccggaaggctatcagattcttgataaaaacaaaacttactaaaggggataacgacaatgcaaattaaccgtcacactgtaggaactaatgtagcaagcttaggagcaatcacaaacgaagagcgtatcgaggaaatgacgaatcatttcaattacttcagagggaagatgttcgaagaagaaaacaacttcattgaaacatacgacgatggaaagcctaaaaagcgtttcaaaatcttcacagatatgacaatacctgtttgtgttgaacttgatgcggaggatgaacaagatgcaattgaagcgttagaacagacaggagaaatgggcgttgatttccctcatatcatgttggatatggggggaggtaaaacagttatcccaactgtcacaaacaatgtgttttacatagatgaagattcatatgcagaagaagtggaagaccatgaataaaacagaattacataatgaacgtttctgtcaggttgtatttgggggattgatcgtagttgtaccagctttaagcatattgtgcatagcgtggtttggatgattaggaagagtgtcaccagcactctcctaatctgatgggttagtacactcccattgtatttaaacataacaatttaatcaaggggataactgaaatgaaaaacacatataccacttatgaatttaaagcatatgataggcgaaataaattgctaaaagaaaggtttacatgcaattacaaagatcatctttattcaatcatagagtggattatcaagaaatgtcctaccgttgatgtgattgaatgtatggtatctgaagtcagtgagcttgctttctgtaagagtgagtatgtcgatatcttcacggtgtggaaagcagacgattgaatagacagtgaggacggggagaggtattccctgtcctctgcagaccctgtattactacaatcggattattatcaagggggtagcgttttgcgagccccttaaaactgaatacagtcagtctatgctcctgaattaaggtgttgtctttagtgatgccttttttcgaaggctccaatatggcgccatcgccacaagtggcaacgaaagagactgccgtggaatgctctaacacacgtaaaacttgacagggtagtgactcagccgacgcaaaaaatgaggataggatgccttctgtgtttccctatttacacatgcatctgaaaggcgaaagctgccattaagtgctgacgaaggaagggtgtatcgtttctgacgatgcaggacaagccacaagtatcagggctcagattagagctttgagaacctgttagggacacttgacacagtaggcttgtttggggaataaccaacggcaaatagggtgaacacacggataccacaagtggatatacaatcaagtttcagtcgcctgcctgagtttgtttattttttttacaagcaaattcaggcagacaacttgtccagccgttgtccacagtctcaaccaatcaagcaaaaaattaaaagaaaagtcaagacaaataacaaaagttttgacgatgaatggaggttaaagcgattgaaagtgactgtaaccaaaaaggagcatgaggacttagaaatgtttctcaagatgatgggagataagacgttaacaatatcccaacgaagacaggcgagaatacggtacaatatgatctacaactgagcgaaaagaagaacgctgctgaatgagtataaggggagtttgtgagtttttaaaaataataatcttagccaataaaagaagaagcaagtataacctgcttcttctcaaccactttaatttagttaacattgtattcaagagttccattgtttacagtgatttttccagaattggcggcactcactagtttaaaagtgtatgaacttcctttttttctaagtgatctccaatcaaatggaacccacccagatgcattcttagctacacctttaccaatgtaagtttttttattagaagcatacattcttacttcaaattgtttaggtctattatttaattctatagacatagcaccagggtttttgaaggcgtatccaccttttacccaaatatagtttgagaaagtcgtcttaccgaaatcataatacgaaacaccttttttggatgcagccaatgaaaagaattttgtagaaggtgtgcttgtagcttgcttttcttccgtatagctctctacacttacaagtttattgtttgcatcataatactctacttgagctgaagctggggtgttagttccttttgattcttctgcactagcagaaataggggttagagagccaaaaatcaacaaaccgacaaagaaagttaaaaataaagcttttttcaatgtttttacctccatatgtagttattacgaggaaattataccacatatgtcatatattatctatttgtttttcaatgtttttaataggaagaagagtgatatcagaacataaataaatgaacatatcattaaagtggtaaccactggatagtgtttagcagagtaaatgaaaaaatctaattgagaaatttgatctgggctggtgattttatcaaccccattaaatagtttggagaacttagctgtatagttccactcgaatatatctgaagcaagttcacttccttgataccaattcacagcaattaaagatagaaagatcagaaaagacaatccaagttgaacaactaaaagtattttcttcaaatttaatgcctccaaatcataacaatttgttttctatgttgaaaagagaatagaattcattacttaaagtcttgtatactaattgattaacatccagagaaaaccaagcattattttaccacaataaagaataataaacaatttttaaggtgtcaaaagaatcgaagtaatctttcaaaccatagagcaaacggacaaattgtctcctggatatattttagaaaacggaaaagtccgttctctaaatttccgatgagtaagtatagagctcgttcataatgtgaacgactaaacagtatcgtttgattgtgccaaattggcacgaactaattcaaaactcaatatgatcaggcaaaatttgcgtgatcaactctaaaatgattttcggaaattccgaaaggccaatgcgatcttgttacaaattgtaataagagacaaactgagatgcttgaagacctgccagtatctctaacatatgaaatagcgggctggagtcgcatttcacgacgtcagaagctggatagatgttttgcccagtcagatatgccgtcgcaaaattgcgctctctttcaaacctaactcaatttgatttgggtcaatgctttaatccaaagttggatttaacgatttcttttacataccctcaaggtgaaggtatgttgatgtacactcctataattctgagggcatggatggagtcctgttttgttactccataacacattgtgctgcgggtctttttgtgtcaccacggagtcacacaaacattttaaactacttagaaacaacaaatatcaatcaggaaactaaatcccatgaagcttgatatgacaagggtttaggcgattttttaggattgttaaagattattcagaatacgtgtctcgtccttgacagggtagaggtcgctggttcgagcccagtcggaatcatagccgaaacccttgcgcagcaagggttttttattttttattgaaacagctctagaggcttacattattccagtaagaagggcaaggaaatggcattgattgctattatgcactgaaaaccaaaaattcgtcagaccgttcctaatgagttctccagatagtaactgcggatcgaaaacaaagtgaaacttgaagcggtattaaagtaataaaaaggtcccttgaatttcaagggacctaaagtttcaatcatcactcttatacctttgggggatcttgtctctccagtcgagtataagttttttgtattttactgtctccatggagcttctatcgttttcattttctgtataaaggtgttctatgactgtttgatcttcttttatatatgcaatggttgtatttagttgaatctcatattcttcagaagaaccatccaatacatcttgaatcattttcaagtattcatcagcttcatctaccgaaacaatgtcttcaatgaaatcagaaaagtattctaactctgcagggagaaccactcgtaagtatcctaaatggtctcttttacattcaaataatattccataataaattcaatcattcccttggttttttatataaaggatatgcagtagctattgagccatctttattaatatacatctctacatctaatacagccgatatggtttagcgactttttgttcatcagagagaaggtaaaaatcccataaaatgtgattgggagaatataaattaagtcctttatataaatctcttggaagagaagatattagtagcatgttagcattattaagtccattattatgggtttttttattaccctctttttctgcagtttataccacttcaatttatctgtcatcaaaaatgcggtcgaacgattcagtccatgtttgttttgaagacatacggcatttacggactaaaaacgaaagcggagctagaagtgaaattgaaattataaaagaagcccttcttataagagggctctttttctaactatgttgttttaaggtgttttttaatttgttcagtgacttgcttaagccattctaatggagttatatcatcttcaggaaagtatatgccatccgctgcttcctctataaattcattcttgtcttcttctgaataatcactatttacaaactcagttagtgctattaaatctctttcttttagtttttgtgatgcttcatttaaatatttatcaagtgcatttgccggagactctattccttggtggaaatgtccaccgagaaatctaaatacaggatcagaaactttaatttcaatcattacttatcaccaccaagaaatgaacttcaaatctgagaaatggtgcgtatcgttattctatataactttctgctatatcaatatcgtttgtcatttctaagtcagggcacttttcatctaatttttttaaacaattaataagttctttactgtgcaaactttcagctaaatcttcaaatacctcactgacccaatataaatctgctttattacaattttctagatagctgattgtattttcttcgttttctgaaagcacttcaattatttcatcccaacttttttgaatgccatagtcatcattaagattaagtttttttcttttaattaatatatctttcatttttttctctaaattcatattgattctcttaactaagaagggctaatattttcatattgcttttcctattgttacatctccatcatggaaaaattcaataacataaccagattcgctgaacatgaaggtatctgaacctacagcagttacatcatcaattacgtttaaggcgttgtctaagctggtttttacagctggataatcaccgtaagcccaaaggagaataacagttttattatctattttattctcaactaaccattcatcaatatcttcagcgtaatcaatagatctgtgataagttacttcatcccatttaattcttccccatgatgtgaaggggaaactttcgccaagatgctcatgatatttacgtgtctcagaaatagtgaggacttctttgttatctccaagagcttctagacattcttcgtataaggtcatattaacacttcctatttatttaaatgttttaaaagggatttataagtatcttcgtttccgttaaaaggtatataatatttctttgccttatctccttttccatttctataatcctcaacatttatatgaggtcccttttcgggatcataatctaatctccaaaggactttattatcttcagacattcggccagtaactttaccaaagcctgcgcttttagataaagtacctataaaaggctttgaatctattcctaaatcaccaattagatttagcgcctcatttctagcttgttcatatgtgtctacctttggaagcgcaacttctcttgattttttggaaaggccttttttaactgccttgttttttgatgacttaccattgattgatttaaagagtaccctatctttagtggaatcggctattccttttaggagtggtgtattttttacgttaatagtatgctcagcatcttgaaggattccttctaatgcaggagtataccgattgacaggagatttgtaaaactgttttacagactttccgcctttcttaattgtgccgccaactttagcaagatcttttgagcctgttgagacagaggactttccgcctttcaataacagaagacttccgcccaggtaagtaacatagtgcatccgtgtatatgcatcgccgtgaatcatctttttatcccaatcatccttcaatgtgtcaaccatactttgaaagacacctagatagtcatattccagaacagtatccagaactttttgaggatctttgtttaagttgtcaattgtccaaccgatattccgtccgagttgaagtgctccttcaccggtatccttggcaagatcgtatacaccaacaagcagacctttggcgccatcacctatgatttgcaatgcttcttttccgttatccatgaaagctttacgctgttccagaaatgaaacaaattcaagctgttcaggggtgagattctcatagccaacctttttggcgatttctaagtattcatccgggtcggttacgccatcagccagctttttcttcagatccttgatttcacgctctttcgcttcttcctttttaatcgtcaaataggcatccgaatgtcttgcgatatcgccttttttcttatgtatgtcgctttcacggtacgccttagcgttgtagtgaagcggcgtggcaccttttcctttgcccgtggcgttttgaagtttctggaagtcagcttggatgaactgttcgttcgcttcggtttctgcgtattctttcgttagatcgtgatcaagtttgccgagtttatgtatcgtttcgcttctttttttgtcagctgaagaaagcttctgatctgtgctttcggttgaaaacaattcgagcgagatgatgccttcgatctctccgaggatggaccccatgtcctttttctgctcttccataatcgcctttgatttactaagggcgtgggtgagctcgtgctccagaaatgattcctccacatgcgaattggaaagtccggcgtcttcgaccttgccgggaaggcttgtgagaaatgcgattttcatatcgatcagatcaagccagctgtctgtgacgccggcgtggtccttgaaaaacgctttgatattgtcagcgccccggcctgagaagtcgctgtcaccgagatcagccatgccttgaaaggctttttttagattgaccatttggttgcggagttctttgtattcgtttgcgcgttgtttggcggcagcgaggagggtggttgcttcgaaaactttcatgaccatatcctttcattcgaaatacttcaacaagatattaccatggaagaatgaggaataaggtcaatgtactatctaaaatggtaaaatgaatcatttgacccacttctttgtccttgtaattatgtgattaagcatttgagaagagagcttatggatgagaaaccggagtgtagggaattactcggcagcgtttgaattaagtgaattggaaagattaagccggttaaaaaggctggaacatatttttagataatgaattgtagtgtgtaaaagatgaaaatggcgtaattcaagatgcaggtgatttattaaccggaattgatatattaacggaaaataatgtataatgtaccgggcagctttgaactcattgaatgtgatgaacatgaagaagtggaaagtttttataagataaatcctgactgaagagacttaattgaatgaaaattaacataagtctatttaccctgttctttttaggaggaaggtatgtcaatattaacaataatagaaatcgcattagtggcaactgtattaggtttatttgcatggacttttaaaaaagagaaaaatactgatgaagatgtattcaattatgctagatatatgatttatttgcttgtagctgaagttgcattgtatgccgtgtttcaaatggtttaagtttaaacacgtctttactctagacaaagagagatgtgaacaatgataaatgtcttaactaatattttaaaaaatgacagattagatgaatacccattattacatagagagtcccgatttctggggtagcatatagtgttctaagtgatgataagggtttaaaagaagtattttttagagaagaagagtttattggaatgagatggatggcatttgactaaaaaaatcagagacagaatgccccgttttaacctataaatctaatgattaaacactgggggtttttgtatgagtaaaattaccaatactggcaatatgcaagatattggtggtattaagctttattacgaattttttgaaaggcaaaatgaaaacattacagtcatatttgaatcagggtacggatgcccttctgcttcttgggaccctataaaaggtgaaatttcaaaatttgcgcaatttttcatctacgatagagcaggtttaggaaaaagtgaaaaagacgatagaccaaaagacagcaagcagtctgttgaaaatcttcgtacccttttacaaaatgcgaatattaaaccaccatatatgctcgtagggcattcatttggaggagcaaatgtaaggttatatgcttgtacatatccagaagaagtagcagcggttattctcttagattcctgccatgaagatcaaaacaaaattatgccgccactattcagtgaagaaacaagatctctttaccttaatcaattttcggtagaaggttctttaagtgaaattcaagatagttttgaacaaatagacaaatgcacatcattaggagatattccacttatagttgtcagcgctggtttacagtcttatcatacaactgaatccttcgctgcgtggaatctatttcaaagagactttctgcgtttatcaacaaatagcaaacatattgttgtgaagaatgcatcacacggtctacatgttgatcaaccccagattattgttgacattattaaagatacattgaaagagatacaaaaataagtttagtttaaaaactctaaaagcagtagatgagggcagtcttgtattggttagaataggtagcaatccttaaacaccgtatcaaaagcggctggattgcacggaatggaaaattctataaagcaatacgataaagagtaaacattttatttagacattatttcttagaggagaaagcttatggatttacttaattggacttacattatatctgcaattataggagctgctgggttcataagtttattgtggttctcttattttaatgagaaaggtgaaaaataaagcagagcattgggtgaatttgtatattgattatgatgatcaaagctaaaaagtaagggggattaatgattgacagaagacttttattgcgatgaagtattaagcggaaaaacaaaagtaaataaagttttagaaaccgagaatgtattggcgtatcatcatacaagacctttttggccggtgcatattgttgctattcctaaaaaacatatctcttctttaatcactttggaagaagacgacaatgaacttttactcgagttgctgggtgtgattaaaaaggttgcagcgaaggtgacaaaagaaagtggttcttgcagggtgcttacaaacttaggagattatcaggattcaaagcatctgcattggcatatagcttcaggagatccattgagataaaagaatccttttaaagtgaaaataaattccaaagaaactccaaggagcagtaaatagccaaaaattgaggatataaaatgaaattgtataatgaatttataaatatagctaaaactcttaataaagagttagacattactccattattatatggctctttaggtcttgaaaaggtaactgggttgaacttttcaccagaagatattgacatccttattcctttaatatttttagaggaaaagtgggaaaaacttaaaaaaattatggaactgcaaggatataaattggttgatttacatgagcatgaatttaggaaaactaatactaaaataggcattgcttacattgaggatttaaaaccatttgcagatgtagattatcataacctaggggtttttgaagatgacggagccaaatatcatttgctgactattgatgattacctcaaggtttataatatgtctttattagatggatatagaagaacaaagaagagtaataaagatcaaagtaaaattaacatattgaataaactgatacagtattaattaaatatttgtacattaacatggcggcaaaatcatcacctcttcaatccatttttgcatctcttcgtttggagttcaataaagaaatatcggccgcatactcaagaccccctcaccattaactttgagggggtctatttttatttatcttattaatttggaatatgcgttgacgagcaattcatattcagtaagatcaattgtttttagattcaccgttctttttgttctcggcaatctttttgtcgactaaatcactttgttcaggttgaatcggttgttagaacatcatgtgacgcacttcctttaaaaagcatacacacacatattagagggctgaaatttacccgaatgaattaggatacggcggcccaaactgctttccgcatggaatcaacctgggcaactggtcaacagctttaaaaacttcatcataacagggaaatgcggcgggcattgggaatataaaggaatataggcttacagctatgaaagatgtatgaaaatccgtcagacggcgaaggaaaggcaatctccatgtgttgtgacagttcgaatgcgggtgtatggaacttcccattcatccgagttatgtcagagggacgaaaagactttttttgaggaggaagcggaatgattgaatttacacggccatcgcctatgaagaaaacatgcacgatgcacccgggaaaggaatctgtcagatcggtttcgtttactgattttaacggcaattctgtaacagtaaccctttgtcaaatgtgtctggctgaattaaaaatgaaagctgcggctgaatacaggagcatgaccgaggagcgggccaaacagaatcgtttcaagattggtgatcatgtgtatttagagcatttgggaatagtcagcgagataaaaaacatggaaggcgttcaagtggcaaacaggacagacgcagacggagtccggaaggctacccctaaggaaatcgcagaatacaaaaaacaggggaagcaatgacggtgaaaaaattattcagtcaatcatttatcagttgtgttacttatgggagcggcggccgttgcgccgcctgcttccgcggcttggtccagatggcaaaatgaattcgggtagagcggccgggtgttttacgaatgccgcgacatacacggccggcgtatacaagaagcacagcggcggcgggctgaatgatacgaatctggtgccgcagggcggctccggcaagaaaccaaacgctgtatcacacgggtttttctcgaaatatctgccggaagaaacactatccattgaagagattcaggggtgttttcaattaaattttcagctgatttcctaactgtcatggacaacatctcacaggaaatatattgactttcatcctgtttgtaatgttaattagaagatgtatacaaaatcattttaatgaggaggcctgaatgtgaaaaataaagcgggaatacaagttggaatatgcattggacttttatgtttaagctttaccggtttcaatcctttattcggctcagcgcatgctgaagcgaagtctatagaagacacaaaaatgacaagctgtataacgaatcagaaatttgttcagcttgagaaaaaatttgatgccaggcttggggtttatgcgattgatacaggttcaaacaagacaattgcttatcggccgaatgaacggtttgcttacgcatcaacctataaagttctggccgcagctgctgttctgaagaaaagctcaaatgaaaaacttaatgccatcatccgctacagcaaagacgatttagttacatattctccaatcacagaaaaacacctggatacaggcatgagcctgaaagaaatctcagaagccgctgtccgttacagcgataataccgccgggaacctattgctgcagcagcttggcggccctaaaggttttgaaaagtcattgaaacagatcggggatcatgtaacgaaagctgatcggttcgagacggatctaaactcggcgattcccggggatcgtcgtgacacaagcaccgcaaaagcactggcaactgatcttaagactttcgctttgggtaacactctaacgactgacaagcgcacgatcttaacggattggatgcggggcaacgctaccggcgacgaactgattcgggcaggcgctcctgcaggatgggaagtcggcgataaatccggagccggaagctacggcacacgaaacgacattgcgatcgtttggccgcctgacagagccccaattgttttggcaatcctgtcaaaccggtttacggaagatgccaattataataatgctcttatcgctgaagctgcaaaagtcgctcttaatgctcttaaataaacattgccgttcattttttatggacggctttttatttgttgagaatgcggtatgccggtttcgatgttataatgtaaagccataaaaagatgggaagagggggagtttcgatgcattacataacggcatgcttaaaaatcatcagtgataaagaccttaatgaaataatgaaggaattcaaaaaacttgaggaagaaacgaacaaagaagaaggctgtattcagttccatgctcatccgctcgaaccatcagaacgcaaaatcatgctttgggagatttgggaaaacgaagaagctgttaaagtccattttacgaaaaaacatacaaaagacgttcaaaaacaagaattaacggaagtagaatggttaatgaaaagcaatgtgaatgagtaaaaggctttgtctattgttggccgactctgccgacaacgatcatcagtttcattcactaaaacccttgctgtgcaagggttatttactttgaaaagttctttatttcgcagtctttttatgggtaaggaacaggcttggaatgaagatggccgcaaggatgatgacggatactaggaatccggcatggtagccttttaaactgttcggaatcgtcggctgcaatccttgtatgacagttgcggtaacggttgcgatcacagctgacccaaagctggaaccgaggttttcaatcatatgaataccgacacccgcttccggaagctgcttgctgtcaaggcctgtataagcgtcactcattaatgggagcataattcctccaaaactggtgccgcggataaataatacgacggaaatccaaatcatacttgtgttatcggtgataaaaataagcgggatagatccgatcagcgaaagaacaagactgaccgtaaccacgtatttcgcaccgatcttatcaatcatttttccgatcagcggacgagtcatgagcattccgactccttgagggattaaagcgagtgctgctccgactgccgtgaaatgacgaatgttttgaaaaaacagcggaagtattaacatcggccccatgatggcaacattcgctaagaacaacccgatcgaagatgataagaagctcttgtttgcaaacaaattcataggcagcacggtttggtttttcttgatcagattatatacaagataaatggctgctgaaacaagaccgatgcccgcccataaaatggtgtcgctattgttaaatgatgcatgatccgccgcttttgtaatagcgtaaatcaatgccgcgctcattaatgacaaattgataatcccgaaaatatcgagtttacgatctttgttgaatggttcaaagtctggaatggttttcatcataagcggtgcagcaatcaaaacgatgaacacgttgatgtaaaaaatccaatgccatgaagcgccttggacgatgaagcctccgatgacaggtcctaagatcgggccgaagatcataggggtgctgacgattgccatcacttttcccaggttttccggacctgccgttttaaccaagagtgttgacataagcggagtcataatgccggcgctgaatccttgaagcaaacgaaagaagataaagttggaaacgtcacggctcatccccgcaaaaacagaaatgacaccaaaggcgatgactgagccgatgaagattttcttaccgttatatttgttcataagccagccggatacgggtactgcaatcgcaagtgctaagacatagcctgtaacggaccactgaatggtatccaatgtcgtgttgaagtctttggtcagtttgtcgatggcgatgtttaccatcgtagagtcaagcattggagcgattgctcccagtgcaatagcccaggcggctgtgagaacttcttttggcagccgaagttcctttcttttatgtgttgacatattattctcctctcaaaatcgctgtatttgtttccttgtcaacaaaataatagagtgattttgtttctttgtcaacaataagagagatataaaaaggcagcccgttttcatggagcggggctgcctatggttttattccgatttgatgtctgcaccaagtttctttatttctgaatccaaatgcctgctgtatgtttccacgaagttcagcatcgtgtcaaattgttcatcggttacttgttcaaacacgattttgtcgcgttcttgaaactctttgtgcaattcctcgtgaattttataaatgacttttccttgctcggtaagcctgaaatagatttctttcttgttaagcggcttctgatagctttcgataaggcctttattgataagcttcttcgttaatttacttatggcgcctcttgtcatataaagagactccgcaagttttgtcacattggcgtcttcaattttttcgatgaattcgatgcaatgcacttcagaaggtttatgccccttaaggctttcttccatcttcagcctattcagccacaccatcttgttaaaaaagtccctgaaatccgtgaggagctgttcttttttgtccatggcccgtcctcctgctcggtggtgcttacacaatattataaaatttttgtttctttttcaacaatcgtaaagttattatttaggaactgagagatagtgcgcagaaataagaaggagggggaacagaagaagtattctatttaaaaagcggttttttaaccgaaacgtgggttttcgggtatttttctttccgtattcgttactttctcagtttcataacaggctaactctacagccttataaaaaagcaggctgcgcaatgagcctgcttgagattcgcatcaatcattttcctgttgcggcgtcataaaaagcgtcaattgcggttgtgtatttcaagacgtttttagacactttggcggttgcgcctaatggatacgcgtctgacagaacgctggagtgagcctcgggctcccagtaaaatacgccggttcctttgccgttcggaaccgctttcaccagttttatggtgtcttttatggtccagtaggaatctttcggattattttcatctccgcccagttcaaccaccatgacttccttgttgtagcgtgaggcgatgtcattcaaattagatgataattggccggtgagctcccagtacggcttaccttcccaatagggatagaatgaaacgccgatgatgtcggtttttcctccgtttttaaagaattgatcaaaccaccatctgaataggctgttgtccgtgccgtgtgccaaatggctgatgaccttggtggccgggctgacggatttcacggcgtcatagcctttgttcagtaaggcggtcaatttgctgaaatcgttcgtgctgccgtcgggcagtaaaattcctgaattcatttcattccctacttgcacccaatcaggggagatgccgtgatttttaagttctttcatgacatcgtacgtatggttatacacggctgcctgcagctggctgcttgaatagccggtccattggttcggcttgatctggtggccgggatcagcgaacacatcactgtaatggaagtcaaccattaccttcattcctaacgcttttgcccttttggccgccgcaagtacgcccgctttgtcactatagccgagcatggtccatgttgtgccgtctttcagccaataatagctgcttggcggattcacaaacactctcagtctcacggcatttattccgtgatctttaagaatctgcaaggcatctttctgttttccgccgtcatccagccagcgcacaccttcatcctccatttgtttcagccatcctatatcagcgccataggcaaacggggcatccgcttttgctttaggagacttctcaaagaatgtaaaagcggtgaaaatgagagaaagacagattgcgtttacaaatacacgtttcaatcggtttttgaacatcacaatacctcctgataaaaaagattgttgattgatttcactctgaatgtttcagctgccattctccaataacgtcgtgaaacgctgaaacgcctgaattccttcggatgtcattttaaaaacgcctgcatcggtcagcgcgcgtaaaaatacattcgcggtttctttttgtaaaacagcggctgcattttccggtgtcacgtcttcatccgctttgatgttttcagcccacggaagatgaatgtctttgatgtcatgaggttcattcagtaaatactttttcacttctgccagctcatctttcaggcggggaggtaaaacggcgagccccatcacttcaatcagaccgatattttcttttttgatgtgatggacatcttgatgcgggtgaaaaatgccatccggataatcttcggaggtgcggttgtttctgagagcgagatcgatttcgaaatccgttcccctgcgtctggcaatcggggtgacggtattatggggttcattcgtcttcgcgatgatgctggcggtttcgtctgaatatccccgccacttttcaaaaacatacgcagcggcatctgtcagcaaatccggatcttttgcgcgaaggcggatcactgataccggccacttcacggcttcggcctgaacgtctggaaaatgacgcatatgaaaagggtagagggaacccgcttttgccatcggaaactcatgggcgccgccttgataatgatcgtgtgaaagaatggaaccccctacgatcggcaagtctgcgtttgatcccgcgaaataatgcgggaaaatttccgtaatggccagaagccttctgaagctgtcgcagctgattttcatcggcttgtgcacgcttgaaagaaagatggcatgctcgctgtaatacgcataaggagagtattgaaaaccccactgttctcccgctaagtcaagcctgatgatgcggtggtttgaacgggcggggtgatgcggtgttccggcatacccctcgttttccatacagagcaggcatgtcggataccggttttccggactgttttttaccgcggcgatgtctttagggtctttttcgggctttgataaattaatggtgatgtccaattctccaaaaggtgttggtgagcggtacacgatattttttcggatggcccgcgtcttaatatagtcgttgttttggctcaatctataaaaataatctgttgcttttttcgggcaatctgataataattcgctgaatgcggcattgatcagagaaggggccggtgtgatcacgtccatgattctgcttcccagcatgtctctttcagccggcgtatcgtttatgattgaccgttttaccgcgtctttcaccatttcgtccacatagtgaagcctgttttgtttcttgatatgtttcggttctgcataatccgtcagtccgagcagatcgagaagtctgtttcttgtgtaaatcacatctgtttcattaatgtcgcctaagacagtgctttctttcagaaaccctgccactgattcaaaaacgtcaatgaccgccgcctccatttcatttgtccttgtatccgtttggatgatgccgatgccaattccatgctgacgcaatgatttccgatatgtccgtttgtttcggattccagcccagaatgttccgcgctttatcgctggaagcgatgagggtgcttggatcaccgggtcttcttgcggccgctcttacttttatgtctctttcggtcacttgccgggccgcttccgccatttctgatacggaaaacccgctgcttgatcctaaattgaaaatgccgctgtctccgccgttttgcaaatattccagagcgagaatatgggcatcgattaaatcggaaacatggacataatcgcggatgcacgtgccgtcttttgtatcatagtcagtgccgaatataaaaacctcctcgcgctgaccgagcgcggtttgtaaaaggatagggataaggtgggtttccggatgatgatcttctccgatggaaccgtccgttttcgcgccggcaacgttaaaataccgaagcgagacatattttatgccgcaggcggtttcacaccacttcagcattttttctgccatgagttttgattcgccgtatgcgctttccggcttttccggcatgtcttctgtgatgggcactttttcaggttcgccgtatacagcggcggatgaagaaaacacaatgtgtttcaccccgaattcctgcatgacctccagcgtaatttgtgtaccgtacacattattattgaaatatgaaagagggtctttcattgattcgccgacaagggattgagcggcaaaatggagaacgcctgttacgatctccttcgcaaacacagagcgaagaaacggtttgtcacggatatctccatagtaaaaaactgctttttcatgaacagctttccggtggcctgtctgcagatgatccacagctatcgttttaaatcctttgtttaataattgatcaaccgcatgagaaccgatatagccggctccgccgagaacgagaatcgccatgatttagttttccctccattcagccgcgccatcgcttatatccgcgatgtagaaagaagcctcaagacctgtcctgctgcggtagtgagatgaaacggcccggataaagccggcggtttcttcactttctacaatggctatggcgcagccgccgaaccccgcgcccgtcatccgcgctccgagtgctccttctttccaggctgcttcagcgagcgcgtctaattcgtcaccggtcacttcataatcatcgcgtaacgaacggtgggacgcattcatcagctcgccgaacgttttcaaatcattcgatttgagagcttccgcggctgagagggttcgctcgttttcattgaccgcgtgccgggctcttttacgcaaagtttcacaggagagaagggattcgagttcgttgaattcttctgccgtcaattccgcaagtgatgcgatattccgatattgccgcagttccgagagagcctcgtcacattcgctgcggcgttcattatattttgaagccgccagctcccggcgcttgttcgtattcataatgacgattttatatccgttaaaagcagccggaatcatttcgtgctcaagcttatcgcagtttaacagaatagccatgttctttttgcctttttgcactgcgaattgatccataatgcctgaattcacgccgataaattcattttcgactctttttccgataagcgccagttcagtatcggaaacatccagactgaataacttccttaaaatggaaccggttaacatttcaatagaagcggaggagcttaaaccggctccgtttggaatcgtaccgtgaaaaagaatatccattccgctgtctatttggccgccggctttaagaaggtaatggatcatccccttcggataattggcccagccgtcttcttttttgtatgctgtggcggaaagatcaaggcagacaatgccgctgtcaggaaagttttctgagtataaccggatctgatgatctccgcgttttgcgcatacggcatatgttccgatcgtaatcgcgcaggggagaacgtggccgcctatataatccgtatgttccccgatcaggttgatccggccgggtgcgaaaaacagttctccgttacttctcttgaaaacgtcttcgaatcttaatttcaaaagttttgcatccatgataaacccccgattctattttgaggtatgctccagtatgaactgaatggctttttgtgaatttctggtgaggctgatatattccgctcctttcgttgcgatgagtttcacttgcaggcgatccgcatcttctttaatgtcatcgtaataagagccgacttgcggagccaaaatgatcatatcgaagtctttcatgatgtcgtaatgggaaccgtaggcgcctgctgaggcggtaatcggcacgttgtattcttcggctccttctgtcagtgcgttcgcaagcatggcgctcgttcccgctccggcgcacagcactaacacattggtgctgtgttccaaggcggatgaggattcctgaagatttgtgctgatgacggaggacgcgtcttctgaggcgccggccatggcgggctgtctctcccaggctttttgcggcgcgctttcaggctcggtgtgttgggcttctttcgccgctaatactttgtcataagctttgcagaatggcaggtatatcaggaaatcgacaatgattaatacagccgtcagcacaaaagccgagagccccatgccggttccgagaatcaagccggcgggcgccggagtggcccacggaagaacatacataaaactgttcattccgatgacatccacaaaaaatttaaacagacagacattcaccatcggcgttacaacaaacggaatgaaaaaataaggatttaaaatgatcggcgcagcaaagagaagaggttcgtttactgcgaaagacaccggaaccgcggatgcttttccgactgctttcaattgcttggatttcgcgaaaagaagaaagataaacggaacaacaagggttgcgccggtccctcccattgtgccgacgaagttcccgagtccgacggtcagcacgttggacgcttgctcgccggcattatgaagctgaaggtttgcctccacatttgcgtaaataatagctgcgatggccggctccacaatagatggtccgtgaacgccgacaaaccagaacagcgccatcattccccaaatgacacaaatcccaagataaccgtctgcggcggtaaaaaacggcgataagagagaggagagagcctctgcaaaagatacgttcagcgtattcctgatcaataaatcaacgatcaccatggccaaaacggaaaaagcgaacggaaaaacatctttaaatgtttgtgaaatggtacccggcacttctttaggcattttaatcgtaatatttttcagcacgcagaatctgtaaacgttcaccgttatgaaagcggatacaaaagcggctaaaagaccttttgtgccgagatattccgtggagaacccgccgtcgatttgagtgacgcttaaaatgagaaacccgacgactgaagcaagcatcgctgaaacggggttgatccctttgtttttcggcatttttcggttcattgattcactcaggcatttcgcacttgttgccgcaacgatcagaccgagggcgcccattgaatagttataaactttccaaagccattcagaaacacttttaggccaagtgaaatccaacacttccggcacagcggcggtgaggatgaaaatgctggcgaataaaataacaggcatggcagttaagaagccgtcgcggatcgcgcctaaataaatgtttcttgagattttttcgaaaaacggttttcccttttcgatttgcttgatgataccgttcatttttccactccttatcggcggcttcggtagagttctataaaatcctgaataagatcacggagcaaaagggttgtcatcaagtggtcctgaccgtgaacgaaaataaaccctaattccatgtccttgccgtcagcttcttcagctaacattttcgtttgcgcattgtgggcgagggttaaattttcatcggcgcttttcaatgctgcttccgtgttttcgaagtttccgccacggacttctttcaggactttcaataaagtgcttctggcgtcgccggcataggcgacgatttcaaaaccgagcatctgcaattcttcctttgtcatgaaaaaacctcctaaagatggcacacatgatgaaaagatactcttttcaccatgtatgatcgttaaatgattgtttttgtttcacttacaagtttgtaccagtaggccgattctttcggataccgtttttgggtgtcgaagtcgacgtaaaaaagaccgtaacgtttgttgtagccgttggtccatgaaaataaatccattaaggaccataagaagtacccctttacattgactccgtcggtaatcgctttactgacggcttctaaatatacttttaaatagtcgattcttgccttatccataatgatgccgtcttcaaactcatctttatagcccatgccgttttcggtaatgtaaattttgttatattgcggatagtcccgtttgatgcgcatcagcatgtcatacatgccttcaggatagatgagccagtcccaatcggtccgcttcaggccttctttgtaaattcgttcgccgattccttttactttatagaccgaagtgcccttatcgcccgttccgttatggtgaataacggtttctccgtcgtacgctttgacgaaatggcattgataatgattgatgccgagataatcattgcgcgtcgaggcttttttcatcacgtcaaagtcactgtctgaaaactcgtatgaagcgccgtttgcctcacagatttcatccagagcacgcatggtttcctcagaataatagccaaggtaggtggcatcgaggaggaatctcactgataacgcgtcatccagaaaacaggcgtggcggtcttcttctgtgccgctggcgggatattttgtttccaatgagtggacgaccccgatttctcccggataaccgccgtctttaaaaagattgacggtcatcgcatgcgctaccatcatgtgatggaggcattgaatgacttttgtgatatcacttttaacagatggcgggaaaaccccgagtaaatactggttggtggctgtgggataaatttcgttaaacgtgctccaatatctgatttcgctgaattctttaaagcaaaactccgcatagctgacgaacgcttctattgcagcgcggttgaggaaatctccctgatcaaataatcctttcggtgtatcgaaatgatgcagcgtgacaaaaggggtgacgctgcgtttatggcactctgagaaaatacgatgatagtaatcaacaccttcctgattgattttgcccgtgccgtcaggaaaaattctcgtccaggctatagaaaggcggatgccgtttattccgaatttttcacatagtttaatatcttccggaaactggcggtaaaaatcacttgccggatcagggctgaatcttccctgtttttcaagaaattcatcccaggccacaggccctttgccgccttcttttgtggcgccttccgcttgatatgccgcagtcgctccgccgaaaataaagtcatgaggtaatttgagcattactgaatcctccttcgccaatgtgtgaattggagtttgttaatgtttgtaattgttatcttttgtttaatagtaaacgcatacatttttgttgtcaatagcttcataaagaaataacatctgtatttataggggttatgtaagtttgtcgttgttttatatgttaattatgttgtttgttagtgtttgtttttgttgaccggattgccgcagtatgttagattgtgtgtaaagttgaggggatgattgaacatgttaaaaaaagagcggcttttaaaaatcatcgatattgtaaactcgcgggggtttattacggtgagtgatattatcgatgaactggaagtttctgatatgacagtgagaagagatctggacgagctggataaggccggaaaaatcgtacgtattcacggaggcgcacagagcatatcttattccattgatcacgaattatcgcataatgaaaaactgggtgttcaaatggaggagaaggagaagatcgcggaactcgcagcttcctatgtaaatgacggcgataccgtttttttagggcccggcacgacgattgaacttttagccaaacacctgctgcataagcgaatcaggattatcacaaacaactatcccgtatttgatattttaaaacatggtgacactgcggataccatcctgattggaggcgacttccgaaaaaataccggtgccttcgtcggccccatcgtgaacggcaatctgcagaaattcaattttacgaaggctttcatcagcgccaacggcatacataatgatgagatttcttcttacagcattgaagaaggggaagctcaccaaatcgcgctgaataattcgcggacgaaatttttgctggcggataataaaaaattcaaccgggaagatttttacgtgttctataacttgcacgatatggactatctgattacggatgataaagtcatgaaagatgttcaaattcattacgagcaatatgtagatgtcaaaatcgcaaaaaaataaaaaaaggcgggcggttcgatgaaaggggttatttttgatttcaacggcacgatgtttcaagattcgcatctgcacgaaaaagcatggtttttcatggtgaaaaaatacgggccgaaaaccatttctgatgaagacattttcgttaacattcacgggagaacaaacagtgaaatcctgacgtattttatttccggcgatttaacaaatgaagaaatcaagaagctgtcttttgaaaaagaagcctactacagagaattatgccttgaaaacaaagacgagttaaagctgacgaagggactgaccggcgtattgaaccatctgaaaaaatcggaaataccgatgaccatcgccacggctacggtaaaggaaaatgtcgagttttactttgacgtctttcatttggatcagtggtttgattttgacaaagtcacgtttgatgacgggagcttccccggaaaaccggcgccggatatttttctcatcgcatcggaaaaattaggcctcaaacctgaagaatgcttagtcattgaagatgccttttcagggctcacagcggcaaaaaaagcaggtgcgggcaagattatggccattgacccgctcggaaaaaaccgcgcgctatttgaagaaaaacagctggcgggtgacgggatactgacagatttcacctcgttttttgaggtgattgccggacattctgtttgagagatcagccggttttcatgcgggtatggctgtacaggctgcagactccgttcgcaacacgggatgtttttgtgtttggcgcttctcgtgaagaaaggagtttcgctttttattcggagtcacttttaagacagggatatccctgtctttttaattcctcgtatttcttccaaagaagcgccaaggtgcctattgctgactgtttatatgtttcacgataaaatcctgagcatacaagaaaaccagccatcctgtaagtccaagccctgatgcggcaatgaaagacagtgaatggcgaagggcgatgccgataatgaccagcataatgactgtagaggggatgccggaagccacgctgaatgcaaaatgacttaatgtctccttcgtttcgccttggatgtacagccaaatcatgctcagcatactgacaattggtaaagccgctataatacctccataactcgggcttcttcttgatatttcagtgataaccccaataatagcagcggagacaatgattttaacgatcgtaaacatcttcagcacgctccttcatcaaactgaatgcttttaagacaagtgttcgttcttcattattcatgttgtcaaaaagaagctgtttaagcttttcttcatcaagaccggaatgccggtaaaggacatccgcccccaaactggtaagttttaaaatgactttcctctcatcttcaacacttctggttttataaacatactttttcttcagtaaccgctttatatgttccgaagcggtattatgcgatacttgaatcgctccggcaatgtcttttattccgactgccttctctttttgaatgacttgcagaatccgtacaccttggtgagtgattttttcatggtgctgataacggagccgatagtaaatatctgtccagaggtcatttaatcgtataatttcgttagacatcataagccaccttttatcgtttattaagattatatcttatattacgatatattttcgcggattgaaagcaatttttgagcatgagggagcggcattcgttctgtttttagaagattggaagagacaagcggccgcagcttcaacgaataaacttatttaatatactctcaataagtcattttccttattttaagaaacggcagcttaataccttccgcatataaataagagcactgacaatatgataaagaaccaaagtatatattcaaatgcagtttttttcagcagggcagtcctgtgctgattgaaaaagatacgggggataaaaagcgggtaagaagataaggaaaggagagagacggatggaacttgattttgtgattcgtctggcggttgcgggtctgcttggggctcttattggattggagagagaattcagggcgaaggaagccggtttgaggacgcattttttagtggccgtcggcagcgccttgatgatgatcgtttccaaatacggcttttttgatttgttatccaacagccatacgtcctttgatccgagccgggtggcggcgcaggtcgtcagcggtgtcggatttttaggagccggcacgattattttgcagcggcatgtcgtgcgggggcttacgacggcagcagggatttgggctacgtcggggatcgggctgacgatcggggcaggtatgtatgtcatcggcatcagcggcacgattttggcgttaatcgggcttgaactgttaaattttctgtttaaaccggcggcgcattctttgtctgtcagtttcaggattgaagagaaagccgtcatgcatgatattttaacttctcttgaggaaaaaggaattctgattacgtcctatgaattgaataaggcggtgcttgaagtgaagggaagggtgaaaagcaaaagcgggaaagcagcggtaatggagaaagttcaagccctcccgtatatcctgtcggtcaaagttgaatagcagacaggggaagcctcctgtctgcagtcatttcttttcaaacattaataccaaggatagaacgggatatacggccgcggatagtatgggtatggtctggggtaataataaggcggccgcggatagtatggatatggtctggggtaataataaggcggccgcggataatgatatggcacccgttcgtggctctcggctgtgtattcatgatcgaaaggatcgtacaagaggaaaacctccttttcaaatgttggttccgtttaccttattcctgtatgcccggtacggtgtatgtacaacgggcaaaaaaaagacgccggttatcatccggcatctttttttacactttcacatcaattgaatggccggcagtcgggtgctgggacggcagcattttcactgtttcttccgccgcagcctgtgcatgctgcatgaccgtttttgttaaagcgatatttacattctgcgccagagatgcctgatgcattgcgattgataacgcagggatatccatagcttccacctccttatcccttcatatcggcggcgtgctccgattttgaagagggctggcggtttctttttacggcccattctaaaagtgcggcagcgcataccccgagggtataggcgaaaatgtcactccagacaaattgccagccgaggatcagcccgccgagcgtgctgcttctgatcgcgtcaatccacggcgcgtgatacagctggctgcattcaatcagaaagcaaaacgagaggctcaaaattgcggctgtttccgtccggatgtgccgaaacaaaagcccgaatcctgtaaaaatcatggccgcccacagggcatctcctaaataagcgtttatgatgccgggcaatagggcggtgatgtatgcggttctggacagcaaaccgagggcgatgataaaaacggtacatattccgtatgtcaatggatgtctattcacttcacactgttcccctttttttgtactcccatgtattgtaaggaacgacggagaagctgtctatgaaaaaaacggcccggaaggccgctttttttgcgttatctggcttttaggttgacatgatctgctttttgatcactgccgatgacgaagcggagctcatactgccccgtatggtagacgtaatctgtttcgcccgtttttggcactgtcaggattttgtcagcgctgccgatttgtttgcttaagacgtcaggtgtgacgctgccgaggtttaagcgccgctcgacccccgttccgaaatagcgtatttccgagatttttccgtttttatgataggaaaatccgtagccggggtttcccatgttccagctgtataaatcaaatggattgcggctgtctgctttttgttccggctcgccgattttattgtaaacgtcctgtcttgtgctttggttgattttcaggcctttcacattttgcggcatttcccctttaaatgccgattggtaaaggctgttcaccagttcttgtgcacgctggttttccgtttttgaagcggctgcggcatggacgggctgtgtatccgaaaatgcttctgctccgaaagcgcatcccgtgagcatcactgccgataatcccgtggcgagtgtttttttcttcaacatatgtgaacgcctcctttttaccgctcatacccgtatgtttcctgagataaacgagatgttttagtgaaaggccggttgggaatcatagaggatgtatagagggggacagaaaggggaaaagaaaatggctgatacaaagaaagttacaatcaatggggttgaaatggaagcgccggacggccaaaccgttttgcagcttttgaacaatagttcaattgacgtgccgcacgtgtgttatcacccgagtctcgggccgattgaaacgtgcgatacctgtatcgtcaatgttaacggggaactgatgcgttcgtgttccgcgcaaataaaggacggagatgtcatcgatacgctttcgtccgatgtgaaaaaagcgcagattatcggcatggacaacattttgcacaaccatgaattgtactgcacggtctgtgattacaacaatgggagctgcgaagtacataataccgtaaaggaaatgaaaatcaatcatcaaagcattccgttcgatcaaaaaccgtatcctaaagatgaatcaaatccgttttaccgatatgatcccgaccagtgcattttgtgcggacgctgcgtcgaagcctgtcaggacgtacaggtaaccgaaacgttaagcattgattgggagcggaaacgcccgcgggtcatttgggatcaggatgtgccgatcaatgaatcatcatgtgtttcctgcggacattgctcgacggtatgtccgtgcaatgccatgatggaaaaaggcatggaaggcgaagcggggtatttaacaggcattaaccaagagacgcttcggccgatgattgacatcacaaaaggggtcgaaaccgggtacggatcgattttggccatatcggacatggaatcggccatgcgggatgaaagaatcaaaaaaacgaaaaccgtatgcacttactgcggtgtcggctgcagttttgatatatggacgaaaggaagagacattttaaaggttgagcctcaggccgaggcgcccgcaaatggcatttcgacgtgtgtgaaagggaaattcggctgggatttcgtcaatagtgaaaagcgccttaccaaaccgcttatccgggaaggagactcgtttcgggaggcggaatgggatgaagcgctgcagctgatcgctgataaatttaccgatataaaagaacatttcggcccggatgcacttgcctttatcacatcttccaaatgcacgaatgaagaatcatacgtgatgcagaagcttgcaagagctgtcattggcacaaataatgtcgacaactgctcacgctactgccagtctcccgccacggccggattgttcagaacggtcggatacggcggcgattcaggatcaattacagatatagaaaaagctgagctcgtgctgattatcggttcaaatacatctgagtctcaccccgtcttgtccacacgcattaaacgttctcataagctgcacggacagaagctcgtcgtcgctgacttgcgaaaacatgaaatggccgagcgctccgacgtgtttttccagccgcgtgccggatcagatattgtctggctgaatgccgtatcgaaatatctgcttgatcacgatttggcggatactgcatttctgaaggagagagtgaacggattagatgaattcgtgaaaagccttgaaccttatacgatggaatatgcggagaaacataccggtgtggacaaggataccttaatcaaagtggcccggatgattcatgaagccaaaagtgtatgcgcactgtgggcgatgggggtcacccagcatatcggaggaagtgatacgagcacggccatttccaacatgcttcttgtgaccggaaattacggcaagcccggcgcaggctcatatccgcttcggggccataataacgtgcagggagccagtgatttcggcagtatgcctgacagcttccccggctatgaaaaagtaacggatgaaaaagcccgcaaaaagtatgaacagggttggggaacagacctgccgaaagaaatcggaatgacaaatcatgaaatgatcgaaggcatccactcaggaaaactgaagtccatgtacttaaaaggagaagaaatggggcttgtcgactccaatatcaaccatgttcatgccgcatttgaaaagcttgatttcttcgttgtgcaggatatctttctttcgcgtacggccgagttcgccgatgtcgtgcttccggcaagcccgagccttgaaaaagaagggacgtttacgaatacggaacggagggtgcagcgcctttacgaagtgtttgaaccgctgggcgattcaaagcctgattggcagattattacggacatcgccaaccgtctgggcgctgattggcactatgaacatccggcagacattatggaagaagcggcaatgctttcgccgctctacgcaggcgtcacttacgaacgtctcgaaggctacaattcactgcaatggccggttgcagcggacggaaccgattcaccgcttttatttacggataagttcccgttttcagacggcaaagcgattttatatcccgttcagtggaccgagccgaaagaatttggtgaagaatatgatatccatgtgaataacgggcggctgctcgagcattttcacgaaggaaatctgacttaccgatcaaaaggaatatccgaaaaaacaccgagtgtgttccttgaggtctcgcccgaactcgccgaagaaagagggcttgaagacggaacgcttgtccgtctgacatcaccgtacggaaatgtgaaagtcaaatgcgtcatcacagacagggtaaaaggcaaacaagtctatctcccgatgaacgattcaaaagacgctgccattaaccttttgacaagcagctatgcggataaggataccgatacaccggcttataaagaaacatcagcgaagatggagattttgaaaaaagaaggagttaatccgcttccgaaaatcaatttccgttatggaaacccgcagccgcagatcggtgtccgggttgagcggaaatgggcgcgtaaagattatgtatttccgggagacgccgtaaaaagggggaaacagcaaaatggctaaagcaatcagcggcatccgaaaacagaccgtcacagaagaagacaaacgaaaaaaggacttagaagagatcgagacggctcttttacgaaataaagacgcgattttggaatctctgcacattcttcagcacatgaacgagcgcggcgttttggcgcttctgcgcgggctcttcggccagggagacaaagtgatggatatcctggtgaagaaggcgaatactccggaaacggccaatatgctgaaaaatctcctgctgttaagcggcgttctcggcatgctcgatgtaaaacagcttgagccgtttatcgttaaaatcaatgcgggcgtcacaaaggccgtcgaggaaaaagacagcggcaggaagacggggtattttgatatcgtccgcgctttaaaagacccggaaatcaacaaggccgtcactctgctgttttctttcctgaaaggcatgggcgctgatacggacgatatggaaagaaatacgcagcctcctgaagaccaaaagcagcaccagaaaccgcagacgaatgagtgaacatatctcccgagcctggccgaaggctcgggttttttgtgcgcttctgctgttttcttgggagaaatttcacctccggatttatgacttttgttgtgttatgttaatagttcaggttatgaatagaaaaaaattgaaaatatgtgctaggataaaattcaaggtacgtcaactattcaaatatgaaacaatcaggagtgatgaaacatgagtaagctgaggagcacgagacaagccatccaaagaaccctgataaaaggaaaaaacggcctggacgtatacaacccttttccttggtacgaaaaaatgagacaggaaagccctatacactttgatgaagaaacgcaggtttggagtgtgtttttatacgatgatgtcaaaaaagtcatcagtgataaagagacgttctcaagcctcatgactgatgtgaaaagctcgattgcaaagtccatgctgaatatggacccgccgaagcatacccaaatcagatctgccgtcaatcgcgctttcactccccgcgtcttgaagggatgggagccgcgaattaaagacattaccgatcatctcctaaaacaggcaaagaacaaagggcggattgatatcgttaaagatctctcttaccctttgccggtcatggtgatttcagaattattaggcgttccgtccgaacgtatggatcagtttaaaaaatggtcggacattctcgtcagcatgccgaaagatgcgagtcctgaagcggcggagaaaaatcagcaggaacgtgaccaatgtgaggcggagctggcggcgttttttgcggaaataatagaaagcaaacgaaaaaagcccggccaagacattatttctattttgataaaagaggaagaagagggagagaagctcacggcagaagatctgatcccgttttgcaacctgcttttagtggcgggaaatgaaacaacgactaatctcatttcaaatgcggtttacagcatattagaaacgcccggcctttatgaagagctgagacaggacccatctctcatcgcgaaaacggtggaagaaacgctgcgttttcgcgctcccgctccgtttgtcagaaggacggtccggcacgacactgaattgcgcggacgccgcttgaaaagcggggagatcgttctctgctacattgcatctgccaaccgtgatgaaaacaaatttgagaaggcgggcgtatttgatattcatcgccaatcgaatccgcacctttccttcggattcggcgtacacttctgcttaggcgctccgcttgccagacttgaagcggaagccgcgctgaaaggaattgtaaaaaccttttcacaccttgagcctgtcgggattgagccgatccgaaacagtgtcatgtacgggctggagtctttagaagcggagataaacgaaaatgagggagaagaaaaaagatgagaaaaacacacatcgccataattaatgtggccgctcacggtcatgtcaatcccacgctgcctgtagccgaggaacttgtcaatcgcgggtataaagtgacattcgctacgactgaggaatttgaagcttccgttgccaaaacgggcgccattcccgttttataccgcacaagcataaaggcggacccggagacgataaaagaacgggtaaataaaaatgacgcgtttgtgatgtttctggaagaagcggttgaagtgcttccgcagttggaagagctgtacaaagacgaccttcctgacatcgtcctgtttgattttttagctcttgccggaaaattgtttgcagataatggcggcatcccggccgtaaagttctgcccgagctatgcaatgaatgagtattttcaattaggaagagacgaagaaacactggaagcggccaaacaggcgatagaagaatatcaggagcagattgaaaatgaacaattgaaacggatgacaatggaagaattttttatgcctgaaaaactgaatattgtctttatgccaagggcctttcagccgaaacaggaaacctttgatgaacgattctgttttgtgggtccgtctcttggagaacgcacaaatacgggaagtctggaaattgatgcagccgatgaccgtccgcttatgctcatctcactgggaacggcgtttaacgcctggcctgaattttaccagatgtgtattgacgcgtttcgggactcggactggcgggttattatgtcagtcggcacaacaattgatccggaaagtttttcggatgtccccgatcactttatcatccgccagcacgttcctcagcttgatgtgctggagaaagcaaagctgttcgtatctcacggcgggatgaacagtacaatggaggcgatgaatgcgggtgtcccgctcgttgtcgttccgcaaatgcacgaacaagaggtcaccgcaaagcgtgtggatgaattggggcttggcgtgcatctgccgccgaaagaagtcactgtggcccgtttgcaaaaagacgttcagaacgtatacggcgataagaacatcctcagccgcgtgaaaagcatgcagcagaaaatagaagaaaccggcggccccaaacaggctgtttacgccattgaagaatttttgaaaacggcggccgtcgaaaattgattgagaaacaggcagcgcaccggaagacggctgcctgttttgttatatgtttttcttcatgccgcatctccggcattccctcaaaaattttccgcccttcactgaacttttaaacagcgtgtagtcgcaattgtcacatcggccgctgtgaacatcaggatattcattgaactcgtaaatgaccgaagtatcgtatccttttgtctcgaactctttttttgtttccatgattgaaagtccctccgcgaatcaaatcgttctgcccggttaatgatacagcaactgcacgggggattcaacgggagcatagcttgattttcccggctgattgcgtaacaataatagaaataaatgacggcctgccatagggcgcccggcatctgaagggaagaagaaaacagcgatgggaaaaggattgaacgggaaacggattgccatcggcggttcgcggaaaacagaagagatcacaaaattaatagaaaagcagggcggaacggcagtcgtccgttccctccaaggaaccgtatacctggcggaggatcaaattgaacccgacgtaagaacatttgccgggcaaaaagccgactgggtgatattcaccacaggcatcggtacggaaacgttattgtcggtatcggaaaaaatcagtctgaaagaagaatttttagcggccgttcatgaagcgaaaatcggctgcagaggctataaaacatatgcggccttaaaaaagctcggcatcacgccgcatgcctcagatgaagacggtacaacaagagggctgatccgctccttggaacgatttgactttaaagataaaaaagtcatgatacagcttcatggcgaaaaagcgccggtcttaacggagttccttgagaaaaacggagcggaggttttccctgttctgccgtatcagcatattccgcctgaaagggagacggtcgataaactgctgggagagctgttaaacggagaggtcgatgccgtatgttttacgacagccattcaagtgcgctctctctttgattatgcaaaagaaaaagggttcacaaaagaattgcagcaggcattcgaaacacaagtgcttgccgccgcagtcggcaaagtgacggctgaagcgatccgggatgaaggggtaaagagggtccttgctccagatattgagcggatgggagcgatgattattgaattatcccgttactatgaatctctgaccttgtcataaaccatcattcagcagggaaaaaagcctacgcttccctgctgaatttttttaattgccagtgttccgtgaaaagggaaggatatgtcaaggcgctgagtatgatacatgtaagaagagcggaggtcatcgttgtaaaaacgatcagcagctgaaagcgcaccgcctgtatcggatcagcccccgctaaaatctgccccgtcatcatgccgggaagctgaacgagacccaatgttttctggctttcaagcgtcgggatcatactgagcttcatactggacgtcaatatctgccggacggcctgcttaggcgttcctccgagagagagaatcagctggatttcttctttccgcagatccgcttccgaactgagcttgtttaaaaacaggcttgagaggaccatggagtttccgatgaccatgccgcttatcggaatgacatatcttgaagtgaacggaatgatatgcagggtcagtaaaagtccctgcgtcacaacttccacgatcgccagtgtcagaaaaacgcgccaaaatgagccgatccgcatttttttccgtttggcgacattgtgcgaagcggccgtgagcatgagaagcaccattagtatgataaacaccgggtgatcaccgcgaaaaatcagcgacagcacatagccgataatgagaagctgaatgacggccctgacggttgcgacgatcatatccttttcgacgtcggctttaaaagatttagacaggaataaagcgataatgacaaatatacttgtcaataacagagaaagatcattcatatcagcacccgctcccttgtaaaagcgcccgggccttttcgtgtttcggttccttaaagaacgttttcgtttccgcggtctctaaaagccgtccctcagccataaaccatactgtatcggataatcgttccgcttgttcaaggttatgggtgatccacaggatcgtcagctgtttttgccgatggagtttcgtaatcagtttctcaatggtgagaacggatgacgggtccagcgccgatgtgatttcatccagcagcaggatggacggcagtccggcgagagttcgccctaatgagagcttctgccgctgacctccggataattcttttgcatttcgatccagaagctcgcgcggaagatctgtaaaatctgcgagctcttcaggcgtatagtgctgtgccccgtggagtttttctgcgagcagaaggttgtcccgcaccgtgccgtccatgacgggagctgattgaaatgcaaggcccgcggtttttctgagctctctgatgtcccagtgtcttatttcttttccgaatacaagcacttccccttcatcaggtgtattcatcagattgcaaagtgacagcaatgtgctttttcccgcgccggaaggccctatcaacgccgtgatagaacctttttgaatatgtccggttacacggcttaggacatcaaaggacgtatggttttgttcaaagcgtttgccggctgacagaaaagatattgccggagtttcttctttcatacaggatgacacctttcgtaaaaaaatcaggaaccggtgagattggctgacgtttgctcagccgttttctggtctgtctgccgggaagcgaatgtatgcatgaccattcccgcaataataatgaacagtccggcaaatgaaagaagtgacggaaacgccgcggataaaaagacgatttcgccgatcagtgcaaaaagaacctctccggactgcgtcgcctcaacagcagcgagcttctgcggctcattcctcaccatatcggtggcgcggaaaaataatactgttgcgataacgccagaactgagtgcgacgataaaggattggaatgtctgtcccattgagggaagcccgtctctatgccagccgaaagcggcgatcaaaagccaaaacggaaggcttgcgagcgtcatgccgagcacccgctgaaacgtatcgagttttccgccgtattgttccagcattttgcggttgccgagcggataggcaaaagcggcgatgacgaccggcacaacgctgaatagtatcgtgcggccggacagagaacccgcatgctgaagctgaatcagaccggctccgatcaggatgatgacggaagtaaccagcgaaatcagcgggatcttttgtctgacagaaaccgggcctgccggtgaatgttttgtttcgtagaaaaacggcgacagaagcacacccgcgacaattgtaatctgccacgtgccggcgatcagccagcccggcccatatgccgccgcaaacgtaatcggggcataaaacagcacgaacccggtaaaactccacttcagccaaaaaaacggttttttccggatttcatgccagagcggcgcccattttcctttcgcataaacgatcaaaaataaaaacggaaccataaaaagaaaacgcagggaagagctccacatccagcttccgccggaaagctccatcgccctgtttaaaataaaggtgactgcaaaaaacagagatgccaatattccgatcacgatggctttcattaaatccctcattttgacacatatttttttatactatactattcaccggcaggcttcgcaatggaatatgaaaaaatagcgttttaacaaatgatgaatgggaaacagacatatacggaggtgaaaacagtgcagaaagaggatattcaagtgctttatttcgaagatgacggccgcattccgaataacccgaatcttccgcttgttatttataaagcggtatttaatgaagaaacagtacagaaagcagagtccgtcctccgccggcacgattggtcgaacagctggacgggcggagtatttccgtatcaccattttcacagcaccacgcacgaagttcttgtcgcggtaaaaggaaacgcggttttgaggttcggcggggaacaaggagtggacgcggttcttcaaatgggagacgcagcggtcattccggccggcaccggacataaaaaactgtcgggcagttctgattttaccgtgatcggggcttatccgggcggccggcagtacgatacaaaaacggagaaaaatgatagaacttcagaagaaatcagccgtgtcccgctcccggaatgcgacccctttacgggaaaatcgggcccgcttttaaaattgtgggaaaaatgacaggggaaaagcggatggtctgtaaaaaaatagcctaaaagaaacgttattacacccccgccatataaataatttcataaacgaaacaattcacgttcaaattttgttcaaaaagtgttattatataagagtaaatcaaattggggttttttatgtttgctattttcagagaggaaaaagaaattttgacttattcaattgtttttgttgatataaaaataatactggatatggcaaagtgaaaaactgggtagtaaacatttatttttgtaaatgattgtgcatgaattcacaatcttgctttttcatgcttttctgcatgaagggggaaaggctaccctttccaaaaaaatcagcatactgcttatagtaaaggagaatcggatatgccagaaacaatcgatcaaacaaatgcatctgtcagccaaggccaacgcgatcttattgatcagctgctaaaacctgaagttcaagaatcactgactgttttagtggatcagcttccaaaactgactgagttagtaaatattttaacgaagtcttatgattttgcacagtctgtagcgacagacgaagtattgaagagcgatacagtgggtgcgcttacagaaattcttgagccggtgaaagaaacagcgaaagaagttgcggctactgcgatcgaagcaaaagaccgcgcggatgcaagcaatgaaacgatcggacttttcggcctactgcgcatgctgaaagatcctcaagctcaaaagctgttccgttttgctaacagctatcttgaaatcatgaacgaaaaacaaaaataatctcagattcaaattgatataaaggacggaggatatacgatgtcaaaacatattgtcattttaggcgctggttacggcggagttctttctgctttaaccgttcgtaaacattacagtaaagatgaagcacgcgtaaccgttgtgaacaaatacccgactcaccaaatcattacagaactgcaccgccttgcagcaggcaacgtgtctgaacaggctgttgctatgccgcttgaaaaacttctgaaaggaaaagacgtcgacattaaaatcgcagaagtcaattctttctcagttgataagaaagaagttgccctttctgacggttctaagctgacttatgacgcgcttgttgtcggacttggttctgttacggcttatttcggcattcctggactcgaagaaaacagcatggtgctgaaatctgctgctgatgcgaacaaagtatacaaacacgtggaagaccgtgtgcgtgaatacgctaaaacgaaaaacgaagctgatgcaacgatccttatcggcggcggcggcttaacaggcgtcgagcttgtcggtgagcttgctgacatcatgccgaaccttacgaaaaaatacggcgtagatccgaaagaaatcaaactgaaattagtagaagcaggtccgaaaattcttcctgttcttcctgatgaccttatcgaacgcgcgacaaaaagtcttgaaaaacgcggcgttgagttcttaacaggtcttcctgttacaaatgttgaaggaaacgttattgatctgaaagacggttcaaaagtcgttgccaacacatttgtatggacaggcggcgtacaaggcaacccgttagtcggcgaatctggcctcgaagtgaaccgcggccgtgcgacggttaacgatttcttacaatctacttctcacgaagatgtattcgttgtcggagacagcgctgtatactttgcgccggacggccgtccgtacccgccgacagcgcaaatcgcttggcagatgggtgaacttgtcggttacaacctgttcgcttacttagaaggaaaaacgcttgaaacattcaagcctgtaaactctggtacgcttgcaagcctcggacgtaaagacgcggttgccatcatcggagcgaactctactccgctgaaaggtcttccggcatctttaatgaaagaagcaagtaacgtacgttatttaacacatatcaaaggattattcagcctcgcttactaatccttaagatcacacagaagacattgccggactttctcggcagtgtctttttttgtatgaaaatgttaacggatacaattttctgaaaaataaaataaaaatgattgatatgtgagaaagaggaagctaaaataaaaaagaaccattttgttaacgttaacatttttaagagggaggatgaaagtgtgaaagcttttatgggtgatgattttttactggatagtaaaacggccgtaaagctgtaccgggaatacgctgaaaacatgccgatcattgattatcactgtcacttaagcccaaaggaaatctatgaaaataaaaccttcgcaaccattacggaggcatggctttacggtgaccactacaagtggcggattatgagggccaacggcattgaagagcgctgcattaccggaaacgcttcagatgaagagaagtttttcgcctgggcaaaaacggtgccgatggcaataggcaatccgctgtacagctggacgcatttagagctgcagcgctggttcggcatttatgacgtattgaatgaaaaaacggccgcggccatttggaaaaaaacgaatgagctcctgcagggagacgggtttggcgcaagagatctcattctgaaatcaaatgtcaaagtcatttgcacaaccgacgatcctgccgatgcgctgacataccacgaactgttgaaagaaagtgattttccggttcaagtactgcccggatttcggcctgacaaaggactggacatcagcagcccgggttttgccgattgggtccgttcactggagagcgcttccggaatagctgtcaccacctaccaatcgtatttagatgcgttagaatcccgcgtccgcttttttcacaatgccgggggaagagtgtcggatcatgcgttagatcaaatggtttatgccgagacgaccgaagaggaagcggcccggatttttgcagccggattaagcggagagcatgtgtcttttgaagatgaaaagaaattcaaaacacggacgctgaaatatctttgcggtctttacaccgaactggactgggcgatgcagttccatattaacgcgttaagaaataccaatacaaataagttcagcagcctcggtcctgatacgggatatgactcaattaatgatgaacgtatcgcaaaaccgcttgcccggctgttagattccgccgaaaaaaagcggcagttgcctaagacgattttgtattctttgaatccgaatgacaactatattatcgccagcatgatcaacagctttcaggatgggaaaacaccggggaaaattcaattcggcacagcctggtggttcaatgacacgaaagatgggatgctccagcaaatgaaagcgttatcaaacataggcctgttcagccgttttatcgggatgctgacggattcaagaagtttcttgtcctatccccgccattaatacttcaggcggcttgtctgcacgctgatcggcggctgggcggaacaaggcgaagcgccttacgatatggagcttttaggaaagattgtcgaggggatttgttaccggaatgctgaggaatatttccgcttttaaaaaatggaatgaaagaggtggcctatgagtaatgtgcctgtcgtgacagcacctgccgcaaaagtgaaggagcttaagctgagtctgaaagaaaaagtatcctatggatttggagattttgggaacggatttatgtttgatctcgggcagatctatttgctgaagtttttcacagatgtcgcaggcattccggcagcgttcgccggcagtatttttttggtcagcaagctgtttgcggctgtgactgatccgattgtcggctcggccattgactacagaaaaaagatcggaccccggggtaaattcaggccgtatttattattcggaagtattattcttgcggtcatgaccgtattgatttttgtgtcaccggacgtgagcgtcacctggaagcttgtgtacgcctatgcttcttacatgctgtggggggtcgcttattctttcgtcaatattccgtacggctccctcggcgcggccattacacaggatgcggaggacagaacggcgctttctgcattccgccagatcggctccctcggcgcgctgctcattacaagtgtcatcgtcatcccgattctcgttcattttgataacgttcacatcggctacccggcagtcatgggaatgatggccgtagtcggaatcgcgggatttatgatctgctaccgaaactgcaaagaaagaattatcgtccgtgaagcgccgaaagaaaagctgtccgtcatgtcggttttcaaatgctttatcggcaacaaaccgcttctgaccgtcgttttcatgacgattttctcaatatcggcatataacattaaatccgctatgcttgtttacttcgcccagtacaatctcaacaatgcggagttgatgtcctacatgagttttatcatcatcggttcttcatttttaggtgttttgtttatgccgaaactcgtcaaacgcttcggaaaaaatcggttttgccgtcagcgccgcggctgatgcgctgaatttctgtctcccgtcaaatgtatatatctttacggcgttagcgagcattgcttttatcgggatcagcataccaaacggcattacgtgggcgcttgtgtcggacattattgattacggagaatggaagacgggtgaacggaaggaggcgacgacatattcgcttttcaacttctccagaaaactcgcccaatctttatcaggttttctttcaggcatcgggctgagcgttatcggctatatcccgaatgcatctcagacaaaaggcacgttaatcgggattaaagggcttctgctgctgtacccggctttcgctttagcgtgcgccatgctgattatcggtttgatgtataagctgacggaccggcagcatgccgagctcgttcaggacttacatcatgcaaaacctcaactttagtgattttatggactgtccgttaatggtacaatagaaataaatgacagcatacagaaagaaaggaaaaacgatggtaaccataaaagatatcgcaaaactcgccaacgtatcccacaccactgtatcccgggcacttaacggcagcccctacattaaagagcatacaaagcagaaaatattagcgctcgcttcacagctgaattacacaccgaatgtaaatgcaaaaagccttgccatgcaaaagtcccatacgatcggactgttttttacaagcatcacaaacggaacctcacacagctttttttccgataccatcaaaggtgtaaaccgcacaatcagtgaggaatacaatttgttcgtccgcgcgattgacgacctgaaaagctttgaaaccattacgcccatgagatatgatggaatcattttaatgagccaaagcgacagtgataattcatttatttatcatattcgcgagaaaaacatcccgcttgtcgtgctgaaccgggacattgatgaccggagcatcacgaatatcctgtcaaacgataaagaaggctccagacaggcggtcgactgcctgatcgcaaacggacacagagatatcgcgatcattgagggaaaggaaggattcaggtcaacttctcagcggaaagaaggctatttgacatctttaattgatcattctattccgattaagcatgaatacagtgtaaaaggccgctatgatatggaaagcggcagtcaggcgatggaaaaactcttggcgcttcaatcaccgcctacggctgttttttgttcaaacgatgatatggcgatcggggcgatgaatgccattttcgccaaaggcctgaacgttccggaagatatatccgttatcgggtttgatgacatcggcatttcccaatacatgacgccgaggctttcgacagtaaaacgcccggttgaaaacatcagcatactcggcgcagagaagattttggcgctaatcgccgacccggatacggcggcggaaaaaatatacgaaaacaccgaggtgatgataagagattcaattaaaaaactcacataacggcccgtctgattatccgggttttcgtacagaaaaatgttaacgtgtgcataaatgcagaaggaggcggacagcttgcgtcagctgaataaaaagatgtgcggtgaatacattcaatatcctgaaaaagtccttcagttcggcgaaggcaactttttgcgggccttcgcagactggcagatcgatcaaatgaatcaattgacggattttaacggaagcgttgtcgccgtacagccgagaggctctgagaaaatcaaacgtttaaacgagcaggacggtttgtttacgctttttttgcgggggataaaggacggaaaaccggctgaagaacacatgatcgtcaaatccatcagccgcggcattgatcttttttctgactatgattcctttaaacggctggcagcacaagaggagcttcgttttatcatttccaatacgacagaagcgggaattacgtttgagaaaggcgaccggcttgaggatagacctcaaaaaacattccccgggaaattagcggcgttcctttatttccgctataaggcatttgcgggtgacgccgagaaagggtgcattgtgcttccatgtgaactggtcgaagaaaacggacggaaactgaaggctgccgtgcttcaatatgccgggctgtgggagctggagcctgattttactcaatggattcatgacgcgaacatcttctgcaatactctcgtggatcggattgttcccggatttcctgttgataccgcggaagaacttaccgattttctcggatacgaagaccgtctgattgtggtcggtgagcattattatttgtgggtgatagaagggccggaacagcttcagaatgagcttccttttgctgaggccgggctgaacgcactgatcacgtctgaccttacgccttacaggacaaaaaaggtgagaatcttaaacggcgctcacacggcattggcgccagtggctttactatacggactgcaaaccgtccgggaagcggctgagcacgaggtgacgggcagattcatcgaagagctgatcaatgaagaaatcctccctgtgctgcaaatggagggtgtcacccaatacgcggcagatgtgttacagcggtttaaaaacccttatatccaacattatctgcaaagcattacccttaacgccgccgcgaaattcaaaacaagaaacctgccgacgctgaaggcttatatcgaacaggagggccggctacctgagaagctggtattttcgttcagcgccatgatctattcatactggaacggaccgaacaaaccggctgacggcgaggaggttcttaaccgttttcaaatggcgcggtcccgttgcaaagatgatatgtttcaagcggcatctgccatattaggagaagagcgattgtgggggaagaatctgaatcatcttccggggctgactgaacgaacggctttttttctgtctgtcattcataagcggggtatgaagcatgcgttacatgaatgctgcggcaaaaagggggaagtaaaatgaaagaggtcataaaaatccataaaaacgataacgtgcttctcgccatgcgccattttaacaaaggggagcggctgcatacagacggactgacgattgaagtgaaggaccctgtaaagcgggggcataaaatcgcgctgcaaaccattgaagaaaacggcagcattattaaatacggtttttcgatcgggcgtgcgacaaggcggatttcggccggcgagcatattcatacccataatctgcaaacgaatttatccgatgtgcaagaatacacgtattcaccgcgcttcgaggacaatccttttacaaatgagaaccggacatttaaaggctacaaaagagaaaacggtacatccggcgtccggaatgaactgtggatcgtgcctacagtcggctgcgtaaacggcgtcgctgagaaaatcctgcagcgcttcgtaaaagaggcgaaagacattgcgccctttgacaatgtgctggttttaaagcaccaatacggctgctcccagcttggcgatgatcatgagaatacgaaacaaatgctgataaacgccatccgtcatccaaatgcgggcggtgtgctggttttagggctcggctgtgaaaataatgagctggcggcgattaaggaaacgctttctgaagtgaacggagatcgggtgaaatttctcgaatcacaggctgtcacagatgaaattgaagcagggactgcgctacttaaagagatacaccttgcggcaaagggagataaacgtgaggagattccgctgtcagaattgagcatcggattgaagtgcggcgggtcggacggtttttccggcatcaccgcaaaccctttattagggagattttcagattacttgattgcacagggagggagcacggtcttaacggaggtgcctgagatgttcggcgctgagacgattctcatgcagcgtgcggcgagcgaagaagtgtttcataaaacagtccgattgatcaatgatttcaagcaatattttatgaagcacgagcagccgatttatgaaaatccgtcaccagggaataaggaaggcggcatttcaacgctcgaagacaagtcgctcggctgcacccaaaaagccggtcttgcaccggtttctgatgtgctgacatacggtgaaaccctgaaaacaaagggattgatactgctcagtgcgcccggcaatgatttaatcgcttcttcagcgctcgccgcggcgggctgtcacatcgttttgtttacaaccggaagaggcacgccgttcggcacatttgtcccgactgtgaaagtatcaacaaataccgatttatttcaatcaaagcctcattggattgattacaacgcgggcagattggcggaagaccaaacaacagaagatcacattgtaagagattttattcaatacattattaaagttgcaagcggagaatgcgtcaataacgaaaaaaacgattttcgggagcttgcaatctttaagtccggtgtgacgttataagggaaaaggcgatctgacaacagaccgccttttcgcgttgactgatcgttttgccccttgatgaattgtgaatatctataggttataataatggaatggtgccttacataaaggagatttttataatatatataattattatggaagattgattttcagtcacatatttcagagggggtcctaatgaataacattttatacattgaagatgaccaagaaattggccaatttgtaaagggtgatttagaagatcggggctatatgattatatggctcacttcttcctataattacgaaacatatatagaaaaggctgatctgatcgtgcttgatataatgatgcccggtttagatggatttacaatcggtcaaaggatgaaaaaaacacatccgcagatcccgctcttgcttttaacagccagaacgggtctggaagataaactgaaaggcttaggatttgcggatgattacgtgacaaagccctttcatcccgatgaactggctgctcgaatcgaagtattattaagaagatttgacaagactgccattcatgaattgaagctaaaacacttaagtgttcacttgaaagaaaaaagaattttaaatcatcaaagtcatgaggaaatatttttaactgataagcagttaaggatttttttgcttttgcttagacatcccaatcaaatattaacaaaggaacaaatttatgaaaatatttgggaacagccttatatcgaaggggataagacgttgatggtacatatccggcatttacggcaaaaaatcgagatcaatccaaatgagccggaaattcttgaaacaatcagagggattggatacaggatcaaacaatgaaattatcaaccaaataccttattaatatcgttgcctcaattttgttttttccgatagcctttttaggcgtgaattttctatactatgtcacattaacatacttgattgatcaccaggggcaagtacactatgaaccaaacaagttggaaagtgattggaagtctgatgtggaagatttttcagggaaatccaatcgggaaattacgtctgcgttcccgcacatgaagcaatataaacactctgatattgtatggataaatgataaggggaaggtgatgttttcgaactcagaacggttggccaaaaagggtgaggttattcacgttagcgaattgattaaaatgatagaacaaaaccaaaagaattatttattgctgagtgcttatttaaatgggagtgaagacagcggatatgcatttttagaaactccgcgctcaattataggatctcaatgggaggttatgagggctaagtattcctatatatggtttattgccttgatttttgtctgttcactttttgtgattaattcatggatgttttttgcgaaaatacaaaaaaggttaatttctttggggaatcatatgaaaaaacaagataatgacggcataccggaatttgtaacagttaaacagaaggatgaactgggccaagtggaatattcattcaaccagatggttgaggaactaaggaacagcagacaaaaagagcgcgaagaaggcgaaatccgaaaaaacttgattgctgatttatctcatgatttaaggacccctcttacggttataagagggcatacatttacgttaaagaatgaaataagcagtgaaaatggaaggcattctttaggcatcataaacgataaaataacgtttatgggcgaactgattgacaatttgtcatcattttctcttcttgccgcaggtaaattgccgcttcataaaaagagttgtgacatattaaagataatacgttcttcgttaacagcttggtatccgatttttgagaaagagcaatttacaatagatattgatctgaaggaaaacatcgtatgggaaatagacgagacttggttgaagagaattcttgataacatttttcaaaatgttttgcgccatgctcattcaggaaaatacgtttccgtacagacaaagctaattgaaaacaaacccgtaatcataattgaggataggggcccgggaatgaataataaatctgaaagaaaaggcgctgggattggcttatcgatcattaatatgatgcttaaacaaatggggcttgaacataaaataaagagcaatcaaaacgggacgatttttattatttatccaaacagcagtgaatacgtgaagccgtagaggcttcacgtattttttatgttgagaaatttaaacgtaaattaaccttgattatatcttctttttaacctcgtaagtttatattataaacagaacaagacggaaaggaatgatgaaaagtgggaaaggctgatccagctttaatatccaaaggtatcaatgtatctataaaaaagaaaaaaattttacatgatataaatttaacattggaaaaaggtaaaatatatggtttattaggtcccaacggtgcaggaaaaacgacattgcttaaagttcttttagggatatttcctccaacttcaggtgaagtgatttttgaggggaataacttatatggcaatccaaataatgatgtgattcagtctataggaagcattatagaatttcctggcttttatgaaaatttgaatctttttgagaatattaaattacatcttaactatttaaaaaaatcagcttctgatgaagaaataaatgagattttaggaaaggttggactttttgaacataaagataagctgttttcgcaaacttcattaggaatgaaacagaggttgggaattgccagagcagttgcgcatgctcctgcattgcttttgctggatgagccgacgaacggtttagatccatatggtattaaagaagtacgtgaaatgctgatccaagaagtaatgaaaaatggaaccacagtcgttatttcaagtcaccttttaagtgagattaatctcatggccgatgaattgcttattatgaataaggggcagattattttcgagtcagcctttatgaaaaatacgcaacatctttatttatacaaaattccagctgaagcgggtattaattgggcggatattgagaaatttgcggatcatgttatttcaaagaataaacagcaattcgagtttatttcagtaattcacccgtcggaaatgaaagagaaattaaattcttgtggatttaacaaggcacctattgacggatttaagctatctttggaagatctttatttaaaactgctggcaaaggagaaaggtcatgagtctgttagtgcgtaacgagtttctaaaacttaaaagactgaaatcaatttatgttattttctttctaagctttttgccatttctcataaacgggatcggtcttttgactatgaacgaaaatacagattggaacaaattttatatgtttgtttttaatcagtattcgaccctatttccgactattatttttattttttcaggtttttatttttatttagaatttaaaaacaggacaatgctgaattggatgtcatatccgtatcataaattcaaattgatattatcaaagctagctgcagcttttctatttttgtttttaatttcagctgttaatcatattattcacttatccaccttgtttttcttttttcgggaagatatctcagcaagcgacttattaagattaatagcgacttcttttacttctactactttgagcctgctaaccattccgattgcagctttaattgcttttttaagtaaaaatatagtggttgtcatgataaccggtgtagcttcctttttaataatgacgatactgttagcaagtgatgtctcaatagcctttcctttttcttttatttatcgtttcagtattcaaatttttgaaagtgatatgggatattccaattcaattcttttagtttggggattactgatcatggggctgtatgttttggtgtccttatcaggattatacgtatattcgaaaaaaaacagaatgtaaatggaggatgagtatacatggagcaagttatttttgtgatttcaatgctcgctttaggagttacactggttacctttttcggaatgattttgaatgacggattaagaggcgtactaaacttttcaagaaaacctgtaaaatttatgactggatcatttctggtatacattgttgcctttgctgtttatattttaataagtgtaaagtaactttttcattttaaggggattcaaagggattcccttattttccttagtaaggggcttggatacaaatgaaagataattgggtgaagcttaatattgagcagtttgcaagaacttttgttttctccttattattgttttttatgcttttgcttataacagacagccaattacagtttaaacagtatagtctattttttgttctaagtatattcggcagtagttgtttatgctttacctatgatgacagaaataagacatatcttcgcagcctgttccgtttttcagaattatgtcaagagggatccgatgcagatcaattgataaaagaactaaccaatgaaatacagagtgtgctcttaggaaagcagattgctcttataaactatgacaaaaaaacattaaaattgaaaggaaatcacattcaggttcctaacataaacatttcaaattttaagataggagaaatacgtgaaaccgccagcggatcaattctgtttatcggggagaagtgtgatacatttgtttttattcatttatcacataaaggacaccctataaagattcgtgaaaacgaagcagattggctgcgaatgctggcattctgcacagcatctgcacttcagaacaaattattgattcaaaaaaaaattgatgaaattatcatagacgatcaacataaatgtaagtcggctgtactttctaaggttttattttctatttcagaaatagagagaaccaagcttgcacaggatattcatgactctatcattcaagagctgatatttgtatgcagagaattagagtatcatgttgagaaatacaaggatatttattacataagagaaattttgctggacaatatccagtatataagagaaaaatgttttgatttaagaccaccttttttaatggagatgggacttcttcgaagcattcaagtcctgattgataaacataaaagcaactatcagcttgatattgaattttttgtagatgtaaaagatgattctatttttacagaagatatcacaataaacttttaccggattgttcaagaactgcttactaatgctgttaaacactcaaaagccagttatattgttttgacgatgattcaaaaaaaaacaagtcttatgtttgtttacgaagataatggaatcggcattgattggaataaagtaaattcaaaaacaaacagttttgggctgacagggatcaaagagcgtataaattgtatgagtggtattcataatatatcttcaggcgtaaatgaaggattgctgttaaggtttgaaataagtacgaaaaatgaatagggagcgctgacatgataaagattctattaattgatgatcatattggtgttgctcaagggacaaaagccattcttgaaaaaagcaataaaatgggagtaacaatattgtcttgctgtaaagaagtacttaatcaccttaagcattacgagtatgacttacttttacttgatttatatatgccggagttaaatggaatggaattgtcaaaaatgattcttagagagagtcccgatcaaaaaattataatttatactggttttgatatctctgtccatttcaatcttttggttgaagttggtgtttccgggttcataagtaagtcttcaacagaagagcatatgataaaagtaattgaaagtgtcattgaaggagataccattattcctacccatctctttaaacaattaagaagaacagaagcaaatacgttcaacattgataagcttgaagatacaataagagatattactttaaatgaaagagaacaagatatcttagcgggcgtagcggagggaatgacaaaccgggaattatcagcaaagctgttgatcagtcaaagagcggttgaatacattcttactggtgtgtacaacaagctcggagtaaaatccagaacagaggcactgatcaaagcaaatcgatattcattaatttctatgaaaactatatatgagtaaatgaatcgggattaacggaacagttaatcccgattttctttataacctatacttcggaaacgcgcaaaaaaaaagcgcttttccgaatatgacttttcggtgcctataggtaaaagatcgtttatcatagatttatagaaatatatggattcagatccaatatatttcaaaaactcaaggggaggaatattaatgaatgagaaaatgtatcgttttgccggtgatttaagagaagaacttgaggaaatttctttaagtgaattcagcggaggaggaggcgcagaacagcgggggatttctcaaggaaatgatggtaagctttgtacgttaacttgggaatgcggtctttgtcctactcacacttgctggtgttaaaacaaatccgaaaataagaaaatagatttccaatgctctgggagatccagctgtctccctcttttttaaaaggagatgaatattaaatgaattcgctgactaatattctattaagtaaagaaaaaaaagctgctgtctctcaatttgatgaaaatgagaatctgtttgatcgaaacttagaattaatctataagaatgatattcaaatggcccaggaaagcattcataatgtgttatccattcaatcaattgataaagtgaaaaacttatatcaaacccccctacataaatccgcttttacagttcatgttttcgaaaacctaaaaaaagggatcgctcaccaagctattaaaaaagaagacgtaaatgaagaaatcatgtttcacgtttttgcgttaaaagtgtcctcttacttcaatgatctacttaaaaaatcaaagtttccttcttatgactatctgctggaacaaccggctctttttcatcattgtatttcaaatcaattagaaaaaatcattttaaaagtctcctatagaacacttgtattggatatgaatatgaatcgggaaaaaggttttttggcaggggagactcctaaagaaaaatatggttattataataaaactcttttgtgcagtccggagtatctcgagagttttttccaacaatatccagtattattaagagtgatcggaaatgaactgagaaaatttaaaaaattcatactggaatttatctcccgttttgaaaaggacaagcctgaactgctctctttatttggtttttcagaacaagtcaaaataagggacattgaagtagggatgggtgattctcattctgatgggagaaaggttactaaaataacattaaatgaaggcaaacttatttataagccgagaagtttagaaattgatctattatataaaaagataattgaatttttgaatgagaaaattagagatcatgatataaaattgagcactccgaatgtccttagcagagacggatatggatggactgaatttatatcttttaaagcatgcaattgtctaaaagatgttcaaaacttttatcagcgtacaggagctcaaatcggtttgttatatgcattgaaagccgttgattttcattcggaaaatctcattgccaacgggagctatccagttctcattgatttggaatccttatttcatcctgcataccagaaaaaaaaggatgggatggacgcttatgaaaaagctgaaacgcagcttcataaatctgtcagagcattaggactgcttccttttttctttgcgggcaaagccgacatcagcggaataggccggaaagggaaagcaaagtcgatcattaaagttcctcagcttatcaatttaaagacagcagaaatgtcggtcaaacgagactatgtcgaaattgatacagctaataatcaccctatgcttgagaataaatttgtatatgcaaaagattatgtcgaagaactgaagcaaggtttttcaaaagcatatatgactatattaaaacacgcttcggagctgattcgcataatagaaaagagcgaaaacaagatatatgttcggtttatatcaaaaccgacaataaagtattctgctttattagaattaagttttcatcctagatttttacacaactctattgatagagaaattttcttatcaaaaatatgggagagaccaaagcaagaagatgaatatcaatctattgttaaatatgagttcaacgatttaattaataatgatataccttatttcaaagtgaaattgaatgagaaagacttactaagctcaaaaaataagaaaattgaaaattactttccggaaacaccagctcaaagtgtaaaagaacgaatttcaaatttatcaaaagacgatttaaagtttcagctctatgttatcgaactgtccatgcttgcttcggaggatgatcggcaaattgttttgaaagaatttataacaaaagaaccaggacaatatgaaaatgttttcagtagttaccaagaaagtatcttaatagaaaaagcagaggaattggccgcttatatttataatcaatcttacaaagcacacacagataaaggaagttcgtattcttggcttaacgctactcctattggagttgatgaaattcaatggaacttatccgttatgggtgataccttttacgacgggctttccgggatggctttcacctacctggctttatggcgcgtcacgaaaaaagaaaagtatctggacattgctgaaaaaattatgaaagatgtcgtctctcgttttattgatattgaggtgaaaccggacgaagacagcagtatgtctgtaggtgctttttccggagtgtcttcaatagtatatactttaatgaatttctatatgtatactaaacgcgaaaaatataaacaggatgcaaaacaaatcgctcagcttattccgtctttgcttccttatgataaagaattggatataatcgggggcacagcgggggctcttattgtaatgatacgttcgtttgaaatagagaatgatacattctttttatcattggctgaacaatgcggttcatttttaatgaaacaagcgatctttcttgatgaggattttgtcacttgggaaggtattgcaaataagccgttaacgggtttttcccatggaaacgctggaatgatatatgcccttcaattactcgagaaacattcaaaacatcaagatataagtatgtacatccgaaaaggacttgcttttgaaaattcaaaaaaagtaaacggtaactggcttgatctgagaaaaacggtaaatgaagctgcaacatctgcatggtgccatggatcccctggaattctattaagcagattagaattgaaagattcaaaacaccctgatattgccgaagtggccaaaaaagatctgaataaaaccgtttctaacattttttatgacggttttggccgagagcaaagcctttgtcacggagacatgggaaatgctttaatactgatcgaatatggaaaaaagactggtgaaagtcaatttgtaaatatcggaaaaaacttgattttggagagtgtacaagacaaaaatataggtttctaccaatgcggagtgggaagggatgttgaaacacctaatttaatgcttggtttggcagggatcgtatatggaatgctgtatgcagcagacgcggaattgccgaatattctcaaccttgaaataggacgtgtagatacattaggagacatttatgaaaattagaaaaagaaagcttccggttattcttcaaagaaatcaatttgattgcggtattacttgtttagccatggttttgagcagggctgagggaataaaaatcaatcctaacaaattaaaattaaataaagaaattatcggaagagacggcactgatttaattgaaatgaaaaggatttctgaaacattcgattatgatttcaaagcattccgcacagacaatataacgcagcttaaagagttaaataaaaaccatccgctaattgttcattggaatcataatcattttgtagttgtggacgcatttggcacagataacgttaaaattatagacccttcatctggcagactgacaatcacattagaagagttcaaaaccttctataatggcatttctattatgttaatcagaaagaacgaaattgagagaaaggataagactgcttcgtcattaaaagatgtgtcttcatttagaaagatcggaaaatatcttttgaaagataaaaaattattgggggttattataagtttcacttttatttttcaagcattaaacttaatgaccccttttttgactcaatatattattgattcatttattgacgggaatgagaaaattcttcccataccaatgcttttcatgattgttattgtttcaatcgcattattctttagtctgtccttactcagaatgaaatttattatcaaactgcaattaaaaattaataagagtatgactgataaaataattcataaaatatttagtcttccattaaagttttttgaggcgaatactgccggggatatctcaactagaatccataacattgctgtaattcgtgaagtcatttccaggttagcgtctactttgatattagatatcagtcttatatttgtatttttcatagtcatgtttgtttattccccgatattatcttttatagttttattgggagcagctatacaggtgatgagtactaaaattttgcttccgaaaattgaaatgttcacaaaacaggaagtaaatagtcaatccaattttcagagccagctaatcgaaatcttaagatcaatgacatttataaaaacaataggagaaaccaggaatattgagagccaattaaattataactttaatcatcagttagattatttctctaaaagaatgaattattcatctttactgggtgcggtctccaatgcaatcaatctatctttgccattatttattttaattgtgggtacttggtcagcagtatctataggccttacgctaggcgcagtaattgctttttctaacattgccggacggtttatgtcaccgcttggatcaattatcggcagtcttgagtctattaaattagtcgaagaaatggtagaccgcgttgaagctgtactggacgaaaaagatgaggaagtaaatgataaaagcagtgaactatttaacccggccgctcataatatcagcttgaaaaatattgatttcagctacaatggaaacgattatattttgaataatataaattttatgatccggccgagagaaaaaatcacattaattggaaaaactggaagcgggaaatctactttgattaaaatcattgccggcctttatcaaaaaacagcaggagaaatttgctacggtgaattcaaaatagaggacgttaatatggttaagctgagagaaacgttaggttatattgttcaagatgtcaatctgtttaatgacactattataaataatataaaatatttcaatgaaaaaataacaatggaagaagttgtacaagctgcaaaagaagcatgtattcatgaggatattataaaaatgcccatggggtatcataccatgattggagaaaatggtattaccttatcaggtggacagcggcagagaatctcaatagccagagtattagcgaaaaatccgcaaattctatttatagatgaaggaacaagcaatttggataaggatacagaattaaatatattaaataacatttacaaaaaggatatcactgtaatttctattactcatagaaccgaatggctcgaattctccgaatctgtctacgagattgaaaatggaaacttaaagaccattaaggccaaatatgaatcgcaactgcagcagacttattaacttgaaaggaggtgaaatatggaatatgaaaaagaacttcagcgcgttgtatgaaacatcagaacaagaattaaaagagcttgttggagggcaaaactcagtatcaataacaacatatccaatcacaaatcatatttgtccaactatcacagtaggctgcgcatgtccgcaaaggcaagtataaaaaacaatcggggggatttttaatgaaaaaagaatttttagcattggaactaatgactgaggaagaattaaaagaattggcggggggatcggaggcaactccaatgactgtaacaccgacaaccatcacaataccaatctctttagcaggctgtccgacgactaaatgtgcgtctattgtcagtccatgtaacgactgaaatttataaaaaactcaaacaataggaggaattaacatgaaaaaagattttcaagcactgactccaatgactgaagaagaattaaaaaaccttgcagggggatcagatgcaaccccgatgaccgtaacgccgacaaccatcacaataccaatctctttagcaggctgtccgacgacaaagtgtgcgtccattgtcagtccatgtaacgattaatcataaccggaaaagaatatgtatatgcgtacatattctttttcttttttgtcgaagacagtcaagaatatataaggaagtgataaatgtgaacaaaacacagaattcggataactatgtttatgaaaactctatgttaaatgtttttaaagaagaggattatttcgaaggttttgcgcaatattatataagtatttttaaagctcagattgttaaagaaatagatagaataccatccgaaagtttactggataagggatgtctagttgaatcgatattaattaattataagaaaaaaatatactatttggcggggaaaacacttatccatgagtttcatcaaacttttgacgagtttgatcaaaaaaatgaatctaaaaattatgatatattctcagaaaggctgaaaaactccgcatttgttgaagaaatactcaataattatcctgtattgcaaggtttaatctccagatccacctctgattttatacgcttcactatatctattattaaacattgggttaatgactataaaaaaatccaacaaaaattcaatctttcgttcggaaaaatgagaaagattaatatgaatgcaggagatgttcataatgggggtaaaagtgttgttattattgaatttgaaaataacaaactcgtttataaaccccgttcacttgaaattgatgttttttatgaaaaggtcattgattatgtcaatcagtattatcaaactaatttaaaaacacctttatccttggatcaaggtgagtacgggtggcaagagtatgtacagtctgaaccgtgcgataatattgaacaggtaagaaattattattaccaatttggaatgcatttaggatttatttatgcttttcaagggtcagattttcattttgaaaatatcatagcatgtcgtgataaaccggtgttggttgatcttgagactctgtttcaaagcagcctctttttttctgaggagaacaaggaaaatgttaatttaatggcatcagcacaggtaaataaaacaatattaaaatctgcactttttaactatatgagttttccggaagataacgggctgactaatataggaggcttgataaacacagaaaatcaaaaaggtgaaaaagaagaagtacttcatataaaaacagataaaatttctatgagaaagaaacaatatctcttcaaaagaggaaggaatcttcctgtttacaaaaataaagtagcagaatgctttgaatttgaaagagaatttattgaaggtttcaaaagaatatactttattttgaaagaagatttatatatacggaaccttataagggatttaaattatgcccctattagaattattgtcagacctacatatgtttatgcttcatttcttgaaaccctcctccatcctatgtatttaaaagattatggagaaaggataagggttttatcttttattaaggatgcttatacaaaatatgaagtatttgattccatcagtccatttgagatcaaggatatgatgatcggtgatataccctattttaatgctcctattagtgaaaaaagggtttattcaaattcaatacatgtggtggatacagggattatgaaacaaagcgctaaacaagaagttttaactcgtttagcgaatatgtcggaagaagacatgcatcagcaagtgagcttgataaatatggccttaagctccacagcggctaatttggatattatttataaaaatcaaattgatgattttgtacctggatattttaaaaatgacatacaaatcaaagagctgattcaaatagaaacagattgtatattaaaacaagcaatcgaatcggagaaatatcttcaatgggtatcaatagtctcggctcccaatggcaccttatccgtaggaccgctgagttttgggctgtacgatgggttagctggagtggggctttatttttcagcttatgattttatttataatgatgaaaaagtcaaatcggttcttcgtaaaatagtgaattcaattaatcaaatatatgagcacagtatttataaaacaaatttctctgctttttacgggtcaagttcttatatctattttgtcaataaaatgagagataccggactttattcggaaaatgaagtgaatagtatgtgtaaagcatacttagagaaacttcgtcaggaaaccggtcaaataacacatactgattttataggcggactcgcaggtatattaaaggttgtgattcagcttggcaggtatcatcggactgaattaatggaagatacggcaagggcagtttgtaaagaaatatgcaaaagagcgattcaaaatagaaatgaagcatattggaaatccgacgcggatgagaatattgttttagcagggttttctcacggtattactgggatttgttatgcactatctgaatattatgcgcatattgaggcatctggagaagtacttagactgattgaatcagctctcaaatacgaagataaattttttgatattaaaataaataaatggagagataacagaaaaaatgagttggattattcttccgcaatgtggtgtcatgggtcttgcggtattcttcttggaagaagcaggatatacgagaatgtagacgggcgtattcacgttgggtatattaatgagtctttagatgacacattgctgaatggaaatttccaccgtcagggctactcattatgccatggaacgatggggaatatagatgtacttcacgctattaaggaattatctctctttaaaaatcgcaagcaagagattgagaatacaattaatatatgggttaaccattttaaagagactctgttaaaaaatggatggcaaaatggaataagaaatgatcattcgggacttggtatgatgttagggaaaaccggacaattatatgcactcttaaggctagttaataaagaaattcccaccccattggctttggattgaggggggatttcctatataaaaaagcgatcctgtaaaggacgcttttttatattaattttattccgctgattaaaataatcgccgccatcacaaactgcagcgggcgcggtgagaatttcggcgaaaagaagctgccgagaagcacacccggcacagagccgatcaacagattcaatacaagcaggtaatcgacgcttccgaagcttgcgtttaacagaccggcagcagttacgagcagaaaggcatgtgcgatatccgttcccaccacttctgccgttttcattctgaacaggtataacatggcgatcgcaaataatgagccggacccaatagatgtcaggccgacgatgaagccgaaaatgacgccgatcagtatcatgagtgtccgcttttcttcaagcgttttttgctgccagcggttcggccgcagttttttatcgaaaaaaaggcgggcgataatggaaatagcgacaagggtcagcacgtagccgagcgcctgtttgataatctgctcctgatgctggtgaaaagcgggaaacaagtgaagaataccgatggcggctgttgcgctgggaatgctcccgagcgccaagtagccgacaagtttaaattgaacggtgcgctgcttccaatgagaaacaacaccgaacagtttggtgatggaattatataaaaggtcagtgccgacggcgattgaggggttgatccctaaaacgatcagtaaaggagtcaaaagcgccgctcctcccacacccgtcaatccgaccagcgttccgacaaagaaacccataaacacaatgcttacagtcatctgtgtgcctcctgaataatcctactatttttatcagattatatatgattaagaggcggtaatcaattaaattttcggaaaattttatacagaacaaaaaaatccgcctgcctgctgttatttcgcagatcggcggatgatggccggattatgatttttgctgataaaacggaagttccgtgtggcccatttctctgacatacacgaaaagattgcctttatgatgaatttcatgctccatggcaagctgaaggagagccgcgccggttatttttctgccgaaagaggcagtcaggtcaatttcgcggttcagctgctcttcagtcagctgtgacaggatgtttgtcgttttttcagtacatgcttcagccagtttgacgaggtctgtttccgcttcttctttcggtttgttctggatagctgatccgtttccgtcgttaatgacgtttgcaaacataagaaaagaataaacgatgtgttttacaagttcctgagcggacattgatgtctctgccggcttgtagtcgtaatgctcgcggctgattttttccgccagctcaatcgtcacgtttcgatgtgacagaaagtggctgaccaattgattttgtgctgtcatgtgaaaacccccatttaatacagaataaaagctgcaaggatatgctatatcaacggcacggaagaaacaagcaataagcctgtgatggagataaatcgttgcggatatccgaaattcgacaattgcggtctttttgcgttcttctttttctagcaattatgataaaatatgacatatctcggtcattccaaaaggggggatttattgaggatgaagcaaactattccgtcctcttttgtcgggctcaaaattaatgaatggtatacccatatccggcagtttcacgtccttgaggcggagcgcgtcaaacgtgaagtagagagagagattgaggatatggaagaagatcaggatctgctgctgtattattcattaatggaattcagacaccgcgtcatgctggattacatcaagcccttaaaggaggacccttctcagcctgagttttcagaattattggaagacattgaaggcaaccagtataaactgacaggactgcttgattactactttaatttttttcgaggaatgtacgaatttaaacagaaaatgttcctaaacgccatgatgtattacaaacgggctgaaaaaaaccttgcactcgtttctgatgacatcgagaaagctgagtttgcttttaaaatggccgagattttttacaacctgaaacaaacctacgtctccatgagttatgccgttcaagcccttgaaacgtaccaatcgtatgagacgtacaacgtccgcagaatccaatgtgaattcgttattgcagggaattatgatgacatgcagtatccagaaagagcattgccccacttagaacttgctttagatcttgcaaaacaagaaggcaatccccgtcttatcagttcagccttatataatctcggaaactgttacgaaaaaatgggagacctctctaaagcagccgaatattttgagacatccgtttccatttgcaggtcagaaaagttcgataatcttccgcattctatttactcattaacacaggttctttataaacagaacactacagccgaagcagagaagcaatatcgcctcgggctcagtatcgcccgcgaatacaatgatgaattgtttgtaaatctgttccaatttttgcatgcgttatacggcaaggaaatggataacgcatccgtcaggcacacgtttgattttctggaagaacacatgctgtatccgtatgtggaagaattggcgcatgatgctgccaaattttacatgaaacacggacagcctgaaaaagcgctcacgttttatgaaaaaatggtgcacgcccaaaaacaaatccagagaggagattgtctatatgaaatctaaactgttgtcaggattgctgcttgttgctgtcgggttcagctttacacaggtgatcggccatgaaagccatttggaaaaccaagcggacggcacattccatattgccgcgcgcaaccaaacataacataaagacccttctttggaagggtcttattttttgcatgcgtatccattccatttttatccgaatgcagggtctatatgctcaagttatctgtcctacgaatgccacctattgatgaaaaaggcataaggagagatgaagagtggggattgaagtgaaaaaacggctcgtatcggctgataaatatgcgttaaaatgtccgaatccgatgacgccggagtatattaccattcataacacggcaaacgacgcatccgccgctaatgaaatcagctatatgacgggaaacagcgaatcaacgagctatcattttgcggttgatgacaaagaagtgatccagggaattccgttggaccggaatgcctggcattcgggagacggcacgaacggtaccggaaaccgaaagtcgattgctatagaaatctgttacagcaagtcaggcggcgaacggtacagagccgcagaagaactggcgattgcgttcgcggcgcagcttttgaaagaacggggctgggggattgacagaatcagaaagcatcaggactggaacggaaagtactgcccgcaccgcattttgtctgaaggccgctgggatgaagtgaaggcgaagattgcaaagaaattaagcggaagtatgccggcgaaaaaagcctctatttcttcttccgcctctgaataccatgtgaaaaaaggcgacaccttatcggaaatcgccgcatcgcacggtgtcagcgtaaaatcgctgcaaagcatcaaccatatcaccgatccgaatcacattacagtcggacaagtgatcaagctcgctcagacgggttcttcttcaaaaagtcaggctgtgccttcctatccgcttccatccggtgtgatcaaagtgacgaaaccgctgacgaaagggacaaacgtaaaacaagtgcaaaacgctttatccgctctttatttttatcccgataaaggagcaaaaaatcatggggcggacggcgtttacggtccgaaaacggcaaatgccgtaaaacgttttcaatccgtcagcggattaacggcagacggaatttacggcccgaaaacgaaggcgaaaattgaagaaaaactgtaatcaataaaacggaagctccccgggcttccgtttcttcttacatacaaactgcggcaagggccttttgaatatcataaatgctttcatcttttttaaactgctttgagacagcgggaagttccgctcctgaaatccaaattttcagctctgaatcaaggtcaaagcggccggcggtttctacgctgaatctggaaatgctcttgtacggaatggattgaatctccgttttcttccccgtgagtccctgtttatcaacaagaataagacgcttatccgtaaagacaatgatatctcgtacgagcttaaacgcggcgttgacattctcaccttccagcagaatacgggccagttcttcttttgcttcagccgtcgatattgtcgacgcattgcccagcaatccattgatgaaccccatgatatatcccccctgatacgtattctatcaaatcatactataaaaaggtttccattcccagatgagtagagtaaactggtgctgactggaaaaggagagcatgttacacatgaaagatagatatgacaatttcgcagccctttcagctgctgaatcggaatacagaattatttatgaagaaaaagagggaagtaaatgtatcgtcctcgctccccacggcgggagaattgagccgggtgtcagtgagctggtgcgggcattttctgaccaaagctcaatttacttatttgaagggacgaagcggtgcaataaccgttctctccacttgacaagcacacgctttgacgaacccctggctttagaaaaagtgaccgcccatcattacggattggcttttcacgggtatcatgatctgaaaaaggcaaatacactcgtcgggggcgcggatttggaaaaagcaagactgatttgtgatctgctgcgtgaagcgggatttgatgccgagctgacagagaagaatgatcggctggcaggtgtaaatcccggcaacattgtcaatcggacaaaaaggaaaatggggctgcaattggaagtgagcacggcgcagagacacgcgctgttcagcaattttggctgccggggagaaaaatatacgccaaccgatctgttttttcgttatgtagaagccgtgaaggccggtttttatgataaatgaacaggggggcccgtttttacattcactggagctatgcggcgcaagaagtgcttggcgggcagcacggtgagaacagcgtcatgatgcaaaaacctttcctgcgatttaaaatgatgacattctgccggctgcgttttaagccggcggagaatcgctaattttcaataaaatacggcgttttttcttcagcggcatgcaagtgtgtctgtccgcttccataatacacattcggccgcttgtcggataacagacaagcgagccgcttctgaaattgaatacctgctttacgccgttcaaacagctcgagccttttttccgcaaatgatgccgtcacccggaaagcggctgcgattaaaataacggcgtggctcctccgctggggaagctccatgtttaacagcataaaggtcggcacacagaagtggtacataaaatggttggcctgaaattcctgcagttccctgaacagcttgttcatatgaaaatggttcccggtatgcttcagcacatggcacagttcgtgcgcaaaatcctgccattgctcttcgggtgactttttttgattcaggacgatgctgtacatgccgtcccgcttcagcatcatactgtgcgtatcttcaaaatgaatccaaatgtcaagctccttggcaatcatctgcatatcaatatggagaggggcggtcattcccatgcggcaatataagtttttgacgtattcctcaagatgtgttaaaaaatcgcccaattgaatacaccctttcgaacgtatgttcttttttaagcgagaaagaaaagccctgatcggactttgaatcaattcccttttcttttaaaaataaacattcagcttttatatcggctgaacgttaagcagtttaaaggaaaagagcggattatttatgttttggcctgcggtttttctctttttcttttaaataattaatgaattcaatggcctgctgtttgctttccggcgaaaagtcctgcatgtcccgatacgcgatctgcaggtcgggatcagcaaacagatcttcatctgaaggttcttttccggttaacaaataatccgttgacacattgaaataatccgcaagcttttgcagcgtttcataatcgggttcagatcggccgttttcataatgagaatatctggcgcgcgagacaccgatatgatttgcgacttcttcctgcgttttctttcctctgagactctttaatcttccgcctatcatccgaatgacctctcttttttcaacaccctaagttacttatgattatagatacaaaatgtatcaaaataaagagatgataaaaaaagtatcaaaaaggtcttgatgatacgaaatgtatcgtatataatcaacatcataaggatacgaaacgtatcaaaatacgataagaaattgatcaggagggtgagagatgcagccgataatcatccgtttcagcagcaatccggctgaccagagatgtttagggaaagcaggcggttcgatatcttttaccgcttgcggacttccggtattccgatttgataaccgattgcagtatgaacgctatataagtctgaagaaaaacggagacgtccaatatgaatcgtaaaagttacccgtttttcatctattccggattattgaattcagaacattatgaaaaaatagggtccgccatatggctgtttttatggttcatcagctcaacgacaaaggaacacgtaaaagacggcgtaaagtgggggatcgtcctcggtcataaacccgtaaaagcaaaagaaatggccgacgtatttgccgtcagcgaaaaaaccgtcagacggtggcttgaggttttggaacagcatgaatatatcaaaaccgtccgcgccccttacggactcatcgtctccataaagcactcgaaaagattcacgccgaaaaagacattgacccgcccggaagtcacagaccggacaatatcggcggatcaccgggacaaaaatgtccggagagaaatagatataacaaaaaatcatactgctgaagaagcgattaacgacattgccgcccattttatcagattaaggtctgcacaggaggggcggagcgtatacccctcgccccgggattatcaggccatcgcccgtattgtttccctcggtgcgtcagcacaagaagcaatcaaatggctcggcgaatgctttaccgcttttgaacagcggcgcacctcttcagctgaaacgatcaaggctttcagctattgcgccaagtatatggaagaccgcttgaatgcacgaattgcgggaaggacaatcacaacaaaaaaagagaggaatacgatacatgacaaaacgaacgatcgagcagatactggccgacctgaaaaacggaaaacgtccattactggcggacagaccggaagaatcagacgaaagccgctttgactgtccgctctgtaaagatcagggcggttatctcaaaaaccagctgggaatggatgtgtgggttaagtgccgctgcgccgccgaacgaaaagcagagcgcatcctcagcgcaagtgagattacagatgcctttcggaagctggatttcaaaggatttatcacgcggggcaagcctcaggcagtcgtcgacgcatatgagtgcgcccttgaatatgttgaaaacttcgacaagatgaaaaactgccggaaaaacagcattgcccttttagggcgtccgggatcgggaaaaacccatcttttgaccgctctcagcaattatgtcatgagacagaagcagacaccggtgctgtattttccttttgtggagggctttacggatttaaaaaatgattttgatctgctcgatgcaaagcttggccgtatgaaacaggcggatgtgctttttattgacgatctgttcaaaccgctgaacggaaaaccccgggcgaccgattggcagattgaacaaatgtacgccgtcgtgaattaccgctatttaaatcataagccggttcttatctcgagcgagctggcatgtgacggattggtgcaggttgatgaagccttgggcacaagaatttatgagatgtgcagcgattatttagtcatcattaatggcaattcatttgacgtaaaccacagattagagggggcgagataatgtgtaagctgtgcgggccgaagaaggtcattgtgacggaaacgggtttcggcgctgtctttcacccttgcccgaactgcaaaacaggcactgatttaacgccggtcattaaacgtcttgagcgaatggttcaagacgcaaaagtgaggcttgatgcacgtgtgcaaatatattaaatggcttttttgcctgctgttcagggcgaaacggatagaaaagcaaattgaagcatggcatgaggctgatggaaagtgaggataaccattgcaagaaaaacacagccccgctccatggcgggccgtacacagcggagaagaaaaacccatttacatttattccgcttacagcgaagcggataaagagaagttcccttattcaaacggaaggctcatcgcggccgttttcaacttaagttcatactctcagcagatcaacgcggcattgatggcgaaagccccggaactttttgaggcggccgaaacggctctccgcctgctccggggagaaagttctgaagaaaaagaagcgtttataaatcagctcgaaagcctcatacatgaagtaaacatcctgaaaaagacggaggacgtaaaacatgaatcctaaaaaactgaccgacattgaacatacaacattaaaaagccagctggaagaaggcaaggttcgggtgattattgtagacggactgaaaaaggaagcatggctcgccgaagcgccggagcacggcaaaacgcttgtcgaaacgcgaaaaggggatctggcccgggtcgaatatgaaatcggctttaaattgaattaaaaacagaatacgtccaagacggaaagcctgcggacactgatcaatcgcgcacatgctgcgcattggttggtgtcctttttttgttccgaaaaagaggaggatctacatggaagacttactatttgaatataaacgcacgctgaaagagacgaaaaagtggtacaagcagctggaggcagccgatgaaacggtgcttacttcagaagaactgaaagataaaaaaatcatcagaacgattattacagatttggagtatgtcatcgaatggcttgaaaaaggccggcagcccggcataagaagagcgatagaccgcagagacgcttatcagagaatgctcattaaagatccgagaatcatagaaacctattcgcaggcgctgatgtttgaaccgtccgcaaatgtgactgaagaagacagaatcagactgcgggacgcattagccgttttaacggatagagaaaaagaaatgctgctgctccacaaagcggaatgcttttcgtatgaacggatcgccgccttgctgaatgtaaagaaatcaaccgtacaaacgacggtcaaacgggcgcttctgaaaattcaaaaacagcaggaacaaagaaatcaatcgcctgcttcataagttgtcatacgtttgccacctagaagtgaatagtagatcataaaaagcggcccgattagaagccgctttttattatagacaatcatgtcggaggtggcggtgatgccgtagcatgaaaaacgcaaaaagagaacaggcatttacaatctatcagtctcataaaggccgcatcacaaatcgcgcccttgccggcaaatcaggcgtatccgcaagaacgatcggcagatggaaaaaagaagggcgctgggacgaggcgcttaataagaacgcggaaagcggcggaaaaaacaccccgggcgaaggtgatgagttaaacgaacgccagcggctgttttgtctttattatgtgaaaagctttaacgatacaagtctttacgatatgatgctaaaagcgttaaagcagacaaaaagccagacggggcgcaattatcagctctattcagaaaaaggcaggctcggcttgcgtgaatggccggagccgtctgacatatgggtgctggaaacaggagttaatatcacagggtatcaatacagcacctcaattgatgataccgcaacccgtgtcgtcatgcggctgcaaaaagacgataaaaccgtgaaggcttccgcctcagacagcgcgggcatgaaaacattcggcgttttgcagtataccgaaacggtttctgcatgtttcattttacctctcttgacagtgagggaaagggaacgtttgggtatgtcattgccatcgattataaaaataatatgttcacgaactatttggatttgaacttgggctggcagggctggcgtcgcctcgttactgaacttgatactgagaatgtaccttggataaatgttccttataaaaatggcgctaaatcaggagacaggccgcttcaataccgcaaagtgggaaacacccttcacctgaacggacacgttcttacggacagagaagtggtattcgggagtgtgccatcctcttgtgcgccggccaaaggcgttgtaacgatggttgcagccagcggcacaaccggttacagcaagtttattatttattctaatggagatatgaagctgacgggaattatggccaatatagaaaataacgtgaacggctattatattgaccttgttttggcactcacgtaaaggagcgagaatatgaaattaatatttccgtatgacaatgacaacatttatacaggcactccggttgagctttatccggattctgagacaggagattatttgatgccggctaacgctgcggactttccgccggaaataaacggcgaaggcatgtggcgcccattttttgatgaagagaaacaagaatgggtggaaacggctgacgaagcatataaagacagcttaaaaaaagatacggctcccgattcaaaccagcttgcaggcctcgggggacagctggcgaatgagaaattggccagaaaagcagccgaacaagcgcagcagtcactcggcaggcaattagcgtctttaaaattagaattattaaacgtaaaaggagaatgaaaaaatgaagagacttaacttttgggtttacgctttgttttataagtgggcctcaatagaaatggtaaaacaggctatgggctatgatgactgctctgccgaagatctggcggaaggtgtggccgcgaagtatatcacgcctgaggaatttcaagaaataacgggtgaaacatacgaaaactataaaaatgctgtgtcataagccgaacggctttttttatttgtcatttttaataaatcagaaaaggaggacggccgatgaaaaagcattcatttgaatttcccgccgatcaacttggcagacccggcgcagtaaaagcttatcgcggtaacaaaaacgattatgtcacaccggttgctgatttgtccggaatgacagagcttcttaccaatacgccgctagaagcgattgaagtatacagccaattcggacaagaccgtttaggagccgtcttaatagacagagcacaggggtgggcttattcggaccgcagcgcaactctttttatcgaagagagcgaggataacaattcgtggacggcttcacattctgtcgcagtcaaaggcggagtgctgaccgcttcggggtgggtcagtctgacaaaaagatattaccggttccgttttgaaaatggaaatcaaaagcagtccgaatttgttttataccaatctgtcggtacgggcggtgatatggcgttttcatatacagacgtgatttttcatgaaaatgcagcagaggcgggcgagggaagcatcttctcagcgggcgcttggaaaaaacttctcgtcgaaatcaccggcacggctgagtcgggccatgtcgcgttttgggggagatccatctcgggaaaaaatgtgccgatcagaggaatcaggtctgaagacggaacatcagccgccggtacatcaggcacagacgaagtgtggtcatttgatattgccggctttaaggaaatcgtcatggaaatcaaaagcatttccggcgggagcctttctgtcaaaggcacggcattttcgtaagaatgaaacttccgaagggaggtgagaacaatgtaagaggggggagcggaagtgcttctggatgaacaagcggtgcaaaaagaattcgcaggaatcaaaggtgaacaaaaggtgcttgaacagcgggtggccgtattagagcgggtatccgaccggcacgatcagcaaatcatgacgctgaatgaaaaactgaataaaattgacgaaaacacaacatggattaagcggaccattacaggagcgatcgtgacagcaatctgcacgggcgtcattggcggagccatcgccatcatgtacaatctgctgcaaaagtaagggggaaaccgatatgaaattcgcggacaaaggcacggtcgtcaggacggtgcttcttttgcttgctttattgaatcaaactttgctgatgttcggcaaatcgccgctgaatattcaggaggaccaggtcagccagcttgcagatacgctgtatgccgccgggtcggccgtttttacaatcataacgactgccgccgcctggtttaaaaacaattacgttacagcaaaagggaaaaaacagcaggctttattaaaaataaacaatttatcgaaataggagagatgagaatatggtaaaaatcacacaggattttatcccggcaggaaacaataaccgcccaggctatgcaatgacaccgatttacattacggtgcacaatacagccaataccgcagtcggagctaacgccaaaagtcacgcaagctatgtgaaaaatcccgatacaccgacaagctggcatttcacagtcgatgatacggaaatttatcagcatcttccgctgaacgaaaacggctggcatgccggtgacggaaacggggacggcaaccgtaaatccatcggtattgaaatttgtgaaaacgcagacggcaacttttcacaggccgtggcaaacgcccaatggctcatccgcacattaatgacgtcgcacggcatcccgcttgcgaatgtcgttgcgcacaagcattggtcaggaaagctttgtccgagaagactgttggatacatgggatgagtttaaagcgggaatcggttctggggaaagacagacgtataccgtccaaaaaggagatacgctgtcagcgatcgcgcggaaattcggcgtcagcgtggccgatctgcagaaatggaataacatcgctgacccgaacctgattaaagtcggacaagtactgatcgtcagcccgccggttgaagcactgtattctcttccggacgaggtgattcagctgacagagccgtacacgtccggtgaaaaggtataccaggtgcaaaacgcgctcgccgcgctttatttctatcctgaaaaaggagctgtcaataacggcattgacggtatctacggcccgaaaaccgcagatgccgtggcccgcttccaatctgtaaacggactgacgtctgacggcgtctacggtcccgctgtaaaagcgaaaattctgatgcagctttaacaaaaaaggctgagtcccgttcacattgcgggattcagccttttttcttttttaaccggttcaatagcccgagattcctcgcccgcatcctcagcgaataagcggaaagcccgaagcgtccgtaatccacaaactttacgcgcctgacaattttcttcacatcatcacctgtcgcatctctttgttggttttattatatgaaagataaggaaaaaaggaataaggacaagagccgtgtctcctgtccttagtgtaatcaagcttttttttgtttatacttgtcaatcagccgctcgttttctttgaaaattctggcggtatgagggctgacctggtaacttgcgatacttgtcattgaacgttttttaaacattttgaacggtttcgctctttgttccggctgcccgttttgaaatgcctgctccatttaaccgtcaccttcctcttctattggcagcattaaatcataaatgctcgttagcgatgtgaaaagcaaataatcgaattccgtcaacaggttttccgacgtgagtttgatcacgtaatggcggttttggactgtaaacggaataagcacaagcctgcctttttgatcatagtagacgtctttacggttaagacgggactgaacgtctgccgcatcaggcatatgctccgtcaagcggtccttatccgattgtgcggaatagtcgcacaaggaagccgtgacattcattttttcggcataagcggccagcagtctgctgatgccttccgcataagcttctgtacttccataatatacatggatcggttcatttttcaacagatattgataggttttcagtttttcaagataggagtgaagcatttcgttattttcttctaaaatttcccgcgtatccgtctctaattcattgccggcgagctttttgatatacgcgctcaaaaagataaacgcatcaataagggcaaagcagacggcaacaatcaaatattgtctccatgcggcaaagagcgattcgggatcatatgtccaatagaccatggagcccagtacaaatagtaaataccacgttttacggatggcaaacattttttcttttacctttgcctcataccgccaggatgcgtacacatataaaatgagtgcggccgccatcgtccacaccataatctgaaaaaacaaaagcatgagcatccctcacaatttgaaaaatggtctgctatgttcattctatgtcatgacatcattttcctgtcacaaaaaaaccgcttctgtaaagaagcggatgtcatcagaaaaacagatctaagatgaaaaaggcgatggcgccgagtgtacctgcaatcggcagggtgacgacccatgtaatgagcatccgtttagccgttccccagtttacgccttttacgcggtgggaagcgcccacaccgagaatggaagacgaaatgacgtgtgtcgtgctgacagggagatgaataaacgtggccccgaaaataatggctgcgccggttaagtcggcagatacgccgtttaccggacggattttcataattttcccgccgacggttttaatgattttccagccgccgatggatgtgccgagacccattgccagggcacaagagagctgcacccaaaaaggaatggcatcacttttatgtaaattggcagtcataagcgccatcgtaatgatacccatcgctttttgcgcgtcgttcgttccgtgtgtataggactgaatggcagccgtcaaaatctgcactctgcggaagcgtttatttgttttcgccagattgctgtctttaaaaatcagcttcacgatcgaatatacgataaagccgagaacaaaggcgatgatcggtgataaaataagtgcttcgataattttaatgaaccctttataattaagcgtcgcaaaacctgacgctgcaatggccgctccggcgatcgctccgataatcgcatgtgaagagctgctcggaatgccgaaataccatgtgatcaagttccaggcgattgcggcgagtagagccgccagaatgacaactgacccgttgtctaatgtataaggattcacaatgtcctttgtaatggttttcgccacaccggtaaatgtcatcgctccgagaaagttcatgatggcggccatgacgattgcgtgccgcggcttcagcgcttttgtcgaaactgaggtggcgattgcgtttgcggtatcgtgaaatccgttaatgaagtcaaataccaaagcgcatatgacaattaatatcgttaaaagtaatagagtatccattataacccctcgttacgcgtttttcataataatggtttcaaggttattggcaacgctttggcaagagtcggcaatttcctcaagcgtttcgtaaatctcgcggtactgaatcactttaatcggatcggtttctgtgccgaacagattttttaatgatttacggtgcaggttatcacagctgtgctcgtattccttaattttaatggcgtgagggtgaatgtccttcaatcggttttctgcaagcagctcaatcgtgattaaaatttccttcgcgcactctctgatgtatccgctgaacttatcgatatgctcatcggaagaagtgatcgagaaaatctccatcattgctgaaaaatgttcgattccgtcaagcacgtcatcgaggctgtttgtcagctcaaggatgtcttcacgttcaatgggagtgataaaagctttgttcagctctttaatcatgacatgaacatgattatctccttttgtttcaaactcttttaacgtatcggcaaattcctttaaagtcgtctggttcgtcactttaaagttgacaaagtattctgcggtttcgtctatgttttttgcgatttctgttaaaaggagtgagaacttatctttttttctttttatcattaaaaaccctccattgtttgaatgagacaatgcacacatcaaattattatatagccttttgtcgaaaaaaaacagataaagtcgaaaaaaacgcctcttgattttttcgtaaaaacgtgtctcatcctgtttttcttatgttacccacttcgccaaaaaaacgtaacatacttcgaattcagacatcttgcttaaaaagtataacaaaagatgtgaatttgctgtcaacttttgcacgtgattttgccagaaaaaaaaacggctcccgtaaaaggaaccgtttttatcagttttttctgccgtttttcagccaaaaataaagcggcagcccggcgaggccgatcaagagggacagcgcgcagctcagtgtatctgtaatgatcgtgctgatcagcacaaacagtgaacccgcgatggccaaaacaggaatgatcggatacaaaggcacgctgtaggcgcgcggttttccgccgcttttttttctgaggataaacacggcgaaaaaggccatgacgtaaaaaatataaatcatgaaaatagagatttcagacagcttatcgggattgctggcgatcataaaaataatggccagcgcgatctgaaatgacacggcaatccacggggtgcggaacgtcggatgaacccgcgaaatctgtccggcaaacggcagctgtttccgttccgccatcgcaaacgagacacgcggaaaagcgagaatctttccgtttaaacagccgaagatgctgacgatgattccgacgctgatcaattttcctccgatgtcgccaaacagcattccggcagcggtgccggtcgcattttcaccgagtttgacgatgtcggtcgcaggaagaatgtgcagcagcgcaaagttaatgaaaagataaatggcggtgacgaccagcagtccgcccgtcatcgctctcgggagcagcttttccggatttttcatctcgccgccgagtgccgcaagcagaatccagccgtcataagcaaacaaggtggccagtatggcagcgccgaaattcatgtccgacatgctgcttgtaacggctgtgaaaatatgctgatcgcctttccaaaggccgaacacgatcatgcagataatcggaatcaatttgccgacagtcgtaattccctgtacgatgccgccatatttcgttccgataatattaatgatgcttaaaaacaaaacggctgaaatcccgatcaatttagaccagccggaatcccagctgaacagatgggccatcaaggagccgaaatacaagccgattgctccgataatggccgggccgtaaatgataatttgaacccatccgcacaaaaagccccaaaattcgccgtacacttcttcgagatatgtataaagtccgcccgttttcggaatctgagtgccgatttccgcaacggtcaatccgcctgcaagcgtcaaaatacctcctaacagccacgcgataagcgcggttttcgcatcaccggagtaggcaagcacggcgcctggtttcataaatacgccggaaccgatgatggtgccgataacaagtgagagggcgatggtaaggccgatctcttttttaagtccgttctcttcaatctgcatatcctttccctccagatgtaaaatcgtcatgatgaaaaaactattttccatattgtaaaccctaattgctgaaacacgaataaaataaattttctgattttgttgttttccctaaaagataaaggtttctgcttttgagaaggaaaaaataccgttttaaaagcgaacattaatggtttttttatatcaaaggttcgttatttaggtagcggcagtctgcagaccgtctgtgaagcagatgggttgactttacgatccggataacataaattgtatatataaatatctcgaaatcgagataattgactggaggataacataatgaaagttaatggaatacaccatgtatcagcattgacggctgatgcgcagaaaaatttagatttttatcgaaatatcctgggactgaagcttgtgaaaaaatccgtaaaccaagatgaaccgacgatgtatcatttgttttacggtgatgaaacagccaatccgggatctgaattgacgtttttcgagattccgcggattgcgccgtttcatgcgggaacaaacagtatttcttcaatcgggctgcgtgtcccggatgcacaagcgctccaatattggaaaaaacgatttgaagagcatcaggtctctcacagtgagatcgtgaaaatagcgggcagggacacactcgcttttcaggatcatgaaggacagcggcttgtgctgacagctgacgaaaaaggaaaagacatcggtgaagcggtgaagcaaagcggcataccggaagaatattctttccgcggtcttggtcccgttgaattgaccgtcccgtatgcagaaccgacgctgcgtgtgttaaccgatgtgctgggcttcactgaaatcgggaaagaaacgcatgaagaccggggcacggttacggtgctcgaatccggaaacggaggcgcgcgtacagaagtccatctcattgaaagaaacgatcttccgcgcgagcgtcctggaaaaggcagcgtgcaccatgtggccttccgcgtccagaatgaagaggagcttgctttatggcaccgcatcattacgaaagaaggtttcagcaactcaggcattgtagagcgttattatttcaaagcgctgtacttccgggagccgaacggaattctgtttgaattgtcaacggacggtccgggatttatggttgatgaaaaacctgaagagctaggcaaaacggttgcgctcccgccttatctcgaacaccgccgttctgaaatagaagcacggctgaaaccgattcagtaaatcagaaatcatgacagatgcctcccggcttgacgggggcatctttttttgcttttttacccgttttgtcattctttttacctatttgtaaacggcaaaataattgtctttgtttattaataaatttttcacatttggttgttacacttgttcaaagttaaacaaaaggagtgaaaacacaggtgaaaatgaaaaaacgcgagatagacgcagtcttaattctcattttactcgcttccgcattcttgaatatgtacaacatctggaatgacgatacggtgaatccttattacaccgcagcggtaacgagtatgcttcaaagctttcataatttcttttacgcttcatttgacgcagccgggtttatcacggtagataaaccgcctgttacataccagattcaaacgatcagcgcgctgatattcggtatgcacgggtggagcgtcatcctgcctcaggcattggcgggtgtaggttcagttctattcatgtacttattaataaagccgacgttcggaaaaacggcggcgcgcatcgcctcatttgtcatggcgtgtacaccgatcgcagtagcggtcgcgcggacgaacaatgtcgatgctttactggtctttttcctcttgttcgccacatggcttctctttaaagcgatcagaaaaggcagactgatctggcttttggcggcattttttgtcgtcggagcaggctttaacacaaaaatgcttcaggcttatatgattttgccggccttcttgctgttctatatgattgcggcaaacaccacgattaagaaaaaaatcatttcattggtaagcgcgttagccgttttagcagccgtttcattgtcatggccgctcattgttgacaatattcctgccagcaaaaggccatatgtcggaagcagccagacaaactccgtattggaattggccttcggatataacgggattcagcggctgacagggcaaagttccggcggcggccagggcgggccggacggaaacgcatcgaaagagatgtcttcttccggcggttcttcacaaatgcaaaaaccgcctggccagtcttcaagcagcagttcagcaagcggagacaaatcacaaaacggcagtatgacggcacctccatctaacgggaaaatgccaagcggcggcgaaatgccaagcggcggtcaaggaggccctccaagcggcggagatggcggcggaggcggtcccggcggcggaggaaaaagcggtacaggcaccggctcgaaaatgcaatcaggttcaggaatgttcggtacgggaacccctggtccgctgcgccttttccaaacggaattatctgatcagatcagctggctcctgccgtttgcgatttttggaatggccggtttattgatcgccggggcgagagaaagaagacgattatcagcagaacagaaggaaacgatcttttgggcagcgtggcttgtgccgattgccggattcttcagtgtcgcagaatttttccaccattattatctcattatgctggcgcctccgatcgcggcacttgtcggtgcgggatgggtcgccctcgttcatctgtaccgcaagcaggcgggatggaaaacttggctattgccggccgctattcttgtgacaaccggatttgagctgtttatcctcagaaactacaatgatcaaatcggcgcaggctggagcatcggagtaggcgttatcggcgcagtggctgccatcgctctgttcgtattcaaacagcgccaaaaaccgctcagttactatgtttcacttgcagcccttctcgtcttgatggtcatgccgatttattgggcgagcacaccgcttctgtacggaggcaacagctcattgcctgaaacaggccctcagctcgcttcaacaagcggaaaaggcatgggaatggataacgcatctgtcaatacaaaactgatcaactatttagagaaacacaacgccggagcggactatctatttgcaacaaccgattccaacactgcggcgccttacattattaaaacgaaaaaagcggtcatggcgatcggcggatacagcgggtctgacccggccattacgctggcccaatttaaaaagctcgtaaaagaagggaaagtaaaatacttcttagcatccggaatgggcaaaggcggaaataacgatattgtgcagtgggttgagaaaaacggaaagaaagtatcttcagataaatggcaatcaaacacagatcagaaaacgaaaaatagtgatgcagctgataaaaaaagcagcaaggcctcaggtaaaaacagccgaatgagcggcgggccgggcggaatgaatcaatcagcttcactatacgaacttcaatctgatgaataggaggaaaaaacatgagcagacatattcaatattcaatagtcgtcccggtttataacgaggaactcgtcattcagacaacctatcagcgtctgaaagaagtgatggatcaaacaaaagagcattatgaattgatctttgtcaatgatggaagcaaagaccgcagtattgagattttaagagagcaaagtctgattgatccgagagtgaaaattattgatttttccagaaacttcggacatcagatcgcgatcacagcgggtatggattatgcagaggggaatgcaatcgtcgtcattgacgccgatttgcaggaccctcctgaattaatccttgatatgattgagcagtggaaagaaggctacgatgtggtgtacgccgtcagaacgaaacgaaagggagaaacctttttcaagaaacagacggcctctatgttttaccggctgctgcggaacgtgactgatattgatattccgctcgacaccggagatttccgcctgctggacagaaaagtctgtgatgagatgaaaaaattaaaagaaaaaaatccttttgtcagagggctcgtcagctgggttggctttaagcagactgctgtagaatatgaacgagatgagcggcttgcgggggaaacgaaatacccgcttaaaaaaatgctgaagctttccatggacgggatcacaacgttctctcataaaccgctcaaggcggcaagttatgcgggaatgatcatgtccggagcgggttttctctatatgtttatcgttttatacatgaagctgtttacgaacagcaccattacgggctggtcctctctgattgtgatacagctgttattcagcggcatcgttctattaatgctcggaatgatcggcgaatatatcggaaggatttatgacgaagcaaaagaccgtccgctctatatcgtgcaaaaagcgtacggcattaaaaacgaaaagatttatcgggaccagcacatgtcttaaccgaaacaccctgtccggccagcgggcagggtgtttttatatcagaaataaaagccgcgggatgacagaatgtcccgcggctttttttattcatctgcgaccggtctgcgtgtgcagagagcgcatgatcagtccggttcccgaaaggttcagtaaaatgcttgcaccaagcgtcattccccaagcagcgttttgctgaggaagctgaatgctcagctgcagcaagatcagaccggtaacgaccagcaaaagtccggtttgtttcatgtgtgtgtatcctcctttgtacactaagtcatacggctgatccaggcctaaagtttcatccgtatataaaaaatccaaggcggctgccttggatttttgttaagaagatgtttcttctttttgagtcagtttcatttttttcgtcatttccttgccgtttctgataatcttcacgtcaacggtgctgccgactttcgtattcttgtagagaatattgcgaagttcgctgcccgtgtcggtttctttcccttttaagctgataatgatgtcttctgcttttaatccggctttggctgcaggtgagccctgcgccacttcgcgaatataaacgcctttattcagctgtttgccgaaaagcccgagtgtgccttcctgatagttttgcggcacttgttccaagtcgatcatgctcacgccgatataagggcgctccacttgtcctttcgtgagaagctcttcggcgatcggttttacatcgttgctcgggatagcaaagccgatgccttctacatcactttcgctgattttcatgctgttgatgccgatgattttgccgtctgtattcaagagcggtccgccgctgtttccgggattgatggcggcatcggtttggatgacgttgatgcttgactcaccggctgacgtagagatcgagacggttctgtttaagccgctcacgatgccctgtgtgacggtgcgggaaaggtcttttccgagcggatcaccgatggcgatgacggattcacccgttctgagagcggatgagctgccgaagcttgccgtttttgtcacgtgtttatcactgatttctaaaacggccaagtctgtcagagagtcgctgccgacgagtttagctgttacatcggtgccgtcatataatgacactttaagggaagaggcgccttcgaccacgtggttattcgtaatgatatacgctttgccgtttgctttcttaaaaataacgcctgaacccgatcccgtttccgcatcttcacccgatgaatttgagtttgaatctgagcttgatccgaatccgaataaatcggaactgctttgctgcttctgcagattggtgattccgacgatcgccggtgaaatgtcttccaccatattcgaaatgctgcttgaatttgccgatgagctgtttgccgatttgctgctgccggaatcagaagatgtctgcttggcggttaccgatgacgtttcctgagcgggagccgtattggaagtatcttgagtctgatggtctccaagcggcgtaaatgtatagatgccgagggcgagccctccgccgatcactccgccgagaagcggtctgaaccagccgaagcttcgttttttcttgtcctcgtccgacgcggaatatccggccggctgcgggttttcttttactaaaaggacttcctgttctttttggtctgtccgattttcatcacgatagttatccatcatgttcactccgtttctctattttcatcatagcatgatttgcctattattactgactccatcttaaacaaaaagtgtgggataataatgaaaagattgtgggaaattgtgaaaaaggcgtaatcggacggaggcgctttatattgacaatttccatcggatttgaaataataaatgagatattatgttcaatccttcacatgaaaagatatgaaaaattctgtcaagctaatgggggaaatctgttagctttttcactttgttaaatagtcagaaaggagttgtcaaatgaaagaaaaacatcattggattatttctctgctcgctgtattggcggtcgggccggggctgatgtcgaataccgcactttcggctgtccaaagccttgtccggcagacggtcggcggggaaaactttgactcttttcatccgattattatcggtaatatggcatttgccttattcgtgccggcggggccgtatttaagaaaaagattcggctcccggcctgtctatatgatttcgatggccgcgggtgtcatcggagcgctccttgctgctgtgacaaatgatatttatccgctcgccgcgggccgttttttacagggagctgcggcgggcactatgctgatgattatgatcccgatgctggtgctttcgtttccgattgagcgccggaattacgcattatttgtgttaatcggcggattttacgggtccgtcattatggggaccgttttaggcacggcggcggcaagcgccggccattggcattggctgttcggcatttttggcctgctgtcttttttcggcctcattttcagttatatgtggctgcgggatgacgctcataaaaatgctgaaaaatctccatttgacggcatcggttttctgttagcgggtgtatcagccgtgctgaccgcctatacatttattcatctgccgaaatggggcttttcatcatggcagacattggcgggatttggaggaagcatcgtcattcttctgatcttgctgatcatgcagtacagaaacgaacatgcgctgatttcgattaaacttatgctgattccaaagccgattctgggtgttttcatgatcgctgcgggcagtatttccatagcggtcagtctttctgcatttcacggggagcttcagaccgcatatcatatgtcacaaactcaactgatattcctatatgcgagccttttgggaggcgtggccatcgccgctgtcatcagtgcattagcatatgataaagtcggtccgggcatgctcggcataacaggctctgttatactggtgttcgtgaatttccaatggataacgacagatcatcatataccgcttattctatttgcggggcttttcgtgatgctggcggccgggacagggcttattgtggcagccggactgatgggagccgcgttaggcggaccgcttccggaactggtgaaacgcatgacggcagttcagtttttaaggctgttcatttatatgggcgcacctgttttaatagggtattttacgaaaagagatgtttccggcatgcttcggggcgcgcgcggcacacaatcgccgcatgacctgctgatgggaacatacagcgatttgtttcttattgctttcatcttaagcttgcttttagtgtgtttatcatttgtcatgaatgcgaccggcatgggacataagctggcgcataaaccgcatgccgtccgtaagcaggcggctgaagagccttcgccgcaggctcctgaaccgatcaggcatcaggtcattcccgatcgtgaatacagaagtgcggtcagacagtttcagcgtcatcatataagcaaaaacggtatgtaactttttctatcagcaaacccttttcccggtgaaaagggtttgttttttcccataatagcagaatggtatattgcatgtttcatccttttttaatataatttgttagaatattcataatttaatatcgaaattttaagtaaaaaaggaggcattacatgaaactgtatctatctgtggatatggaagggatttccggactgcctgatgaaacatttgtcaattcccgcatgcacaattatgagcgcggcagagttctgatgaccgaagaagcaaactggtgcatcgcagaagcgtttaataacggatgcacggaagtgaccgtgaatgacagccactcaaagatgaataatctgctcgcggaaaaacttcaccctgaggcagagctgattacgggggatgtcaagccgttttccatgatgcaggggcttgatgaatcgtattcaggtgtgatgtttatcggctatcatgcgagagcgtcgatgccgggcgtcatgtcgcacagcatgatattcggcgtccgccacttttacataaatgataagccggtcggtgaactggggttaaatgcctatctcgccggattttacgatgtcccggtcatcatggctgccggagatgattgcgccgcaaaagaagcggaggagctgatcccgaatgtgacgactgccgccgtcaaacaaaccatttcaagaaccgcggtcaaatgcctgtcccctcaaaaagccggacggctcctgacggaaaaaacagcctatgcgctcaaaaataaagataaggtcaaaccgctgactccgcctgaaagacctgtattaggcattgaatttgccaactacggacaggctgaatgggcccatttaatgccgggcacagaaatcatcccgggaacgacaatcgttcaatttcaggcaaaagacatgccggaagcctatcaggccatgctcgtcatgacagaactcgccatgagaacaacattctgttaaaggggtgaacggcattgctgcggtattttatcaaacgttttatcgccatgattatgaccgtcctcgtcatcaccactctgacatttgtcatgatgaaagtgatacccggctcgccttttaacgaagagcggggcacaaacgaagcggtccagcgaaatctcgaatcctactaccatctgaacgaacctcttatcactcaatacgccatctatctaaaatccattcttacctttgatttcggtccttcaattaaaaaaccgtcagacagtgtaaacgccatgcttgaacgcgggtttccggtctcatttgagcttgggataacggcgatcatcatcgctgttatttccgggctcgcgctcggcataatggccgctctcaggcgcggcggctttctcgattatgcggccatgagccttgcggtgctcgggatttctattccgaattttattatggctacgctgctgattcagcaatttgcggttcatctgaaatggtttccggcagctacctggacgagtcccgttcacatggtcctgccgactgttgcgcttgccgtcggtcccatggccattatcgcgaggctgacaagatcaagcatggccgaagtgctgactcaggattacatccgcacggcaaaagcaaaggggctttctcccgtcaaaattgtgatcaaacacgcattaaaaaacgctcttatgcctgttgtgacagtactcgggacgcttgccgcaagtattttaacgggcagtttcgtcatcgagaaaatttttgccataccgggaatgggcaaatatttcgtagaaagcatcaatcagcgtgattacccggtcatcatgggaacgaccgtattttacagtgtgattctgatcgtcctgctgtttctggttgatttggcatacggcctgttagacccgcgcataaaacttcataagaaagggtgatcctgatgaatctcccgcaagaaacggtaaaacacacagaagtgcctgatgactggtttcagccgggcgcggaaagaaagggtgaaaccgagtcggtcaagcgtccgagcctgtcttacactcaggatgcgtggcggcggcttaaaaagaacaaattggcgatggccgggcttgtgattttatgctgcctgtttctatcggctgtgttcggtccgctgatatcaccgcacagcgtgacaaggcagacgctcgccgagcagaatcttccgccttctttttcacactggttcggaaccgatgaacttggccgggacgtgtttacaagaacgtggtacggagcgaggatctctttatttgtcggtgtgatggcggcgctgatcgactttttgatcggcgttatctacggaggggtcgccggatacaaagggggccggacagacagcgccatgatgagaatcatcgaggttctctacggattgccgtatctgctcgttgtcattttgttaatggtgctgatggggccggggctcagttccattatcgtcgctctgaccgtgacgggatgggtcggcatggcgcggattgtcagagggcaggtgctgaggatgaagcatgatgaacacgtattggcttcgaaaacgtttggagcgaaaacatttcggatcattaagaaaaatctgctgccgaatacgatgggagccattattgtccaaatgacgcttacagtgccggcggcgatttttgcggaatcatttttaagttttctcggactcggcattcaggcgccgtttgcaagctggggcgtcatggcaaacgacgggctgccggcgattttatcaggccattggtggcggctgttttttcccgcttttttcatttccttaacgatgtacgcgtttaacgtacttggagacggcttgcaggacgcgttagacccgaaactgaggaggtaggaaaaatggcgcagcaagttctttccgttcaaaatctgcatgttactttttcaacatacggaggcactgtaaaagccgtaagaggcgtcagcttcgatttatataaaggtgaaacgtttgcgatcgtcggtgaatcgggctgcggaaaaagcgtgacgtcacaagccgtgatgggtcttcttccgaaacattcggcaaagattgaatccggaagcatacaatttaaacagaaagacctttgccaaatgtcggatcgggaaatgcggggaatccgggggcgcgatatttctatgatctttcaggacccgatgacggctctcaatccgactttgaccataggggatcagctctcagaagcgctgttggaacaccgcgccatgacaagaaaacaagctgaatccgaagttctcgccatgctggatctggtcggtatcccggactcgaaatcccgcctgaagcagtacccccaccaattaagcgggggcatgcggcagcggatcgtgatcgcgatggctctgatctgcgagccggaaattatgatcgccgatgaaccgacaacggctcttgatgtgacgattcaagcacaaatccttgaattatttaagaagattcaaagaaaaacaggcgtgtctattattctgatcacacacgatctcggcgtcgtcgctcagaccgccgacagagtcgccgtcatgtatgcggggaaaatcgccgaaatcggcacgaggcatgatattttttaccgtccggctcatccatacacaaaggggctgcttcgttcagtgccgcggctggatatggaggatagtgagctgtcgccgattgacgggacgccgcctgatttattcgatccgccgccgggctgcccgtttgccgcccgctgcccggacaggatgatcgtctgtgaaaaggtatacccggcaacaaccgtgaaatccaaaagccatatcgttaattgctggcttcaggatcaccgtgcagagcggctgaagcagcagctgacggcagcagaggaaaaagggggattgaaatgaaaaagagatgggcgatcggtgtgattgctgttgtttcgtttgctctgatgggctgtacagccaatgaacaggcggggacagaacccggcaaagcaaaagaacaggggggtgaaacggtgctgcggctcaataacgaaaatgagccgacctcacttgatccgccgatcggatttaataatgtttcctggcagccgctgaataacatcatggaaggattgacgaggctcggaaaagataataaacccgaaccggccatggcggaaagctggaaggtgtccgctgataagctgacatataccttcaatatccgtgataacgccgaatggacaaatggcgatcccgttacggcggaagacttcgtgtacgcctggaaacggatgctcgatccgaaaacgggcgcatcttccgcatttctcggctatatgatcaaaggcggggaagaatttaacagcggaaaaggcaaaaaagaagacgtgaaaatcacggcaaaagataaaaaaacgcttgtcgtcacattggcggcaccgcaggattattttctgagcgtcgtgtccaatccggcgtatttcccgattaatgagaaggtcgccaaggctgatccgaaatggttcactgaagcaaaaacctttgtcggcaacgggccgttcaaactgacggaatggaagcatgacgacagcatgacgatggtcaaaaacgagacgtattgggataaaaagacggtgaaactggataaagtcacctgggcgatggtcagtgaccggaataccgactatcagatgttccagtcgggggatttggataccgcctttgtgccggcagagctgagcgagcagctgatgggaggaaaaaatgtccgcacgtgggatcaggccggactctatttctatcgttttaacgtaaaaatggagccgtttcaaaatgagaagatcagaaaagcgttcgccgcagcgattgatcagaaagaaatcacggattatgtgaccaaaaacagtgaaaagccggcacatgcctttgtatccccgggatttactcagcctgacgggaaagatttccgcgaagcgggcggcagtttattaaatccggatgaatcagaagccaaaaaactgctggaaaaaggcatggcggaagagcattatgacaagctgcccgccgttacattgacatacagcacaaaaccggagcataagaaaatagcggaagcggttcagcagaagctcaaaagtgtgctcggtatagacgttaagctcgccaatatggaatggaacgtctttttagaagagcagaaaggactgaagttccagttctctcaaagctcatttttaccggattacgcagatccgatcagttttcttgaggctttccaaacggataattccatgaaccgcaccggctggggcagcgcggcatacgacggctgcatcaagcaggcaaaacaggaggccgatgccaaaaaacgttttgcgctcatgcataaagcggaaaagctgctcatgaatgaggctccgatcattccgatttacttttacaatcaggtgcatctgcagaacagcggcgtgaagggcattgtccggcaccccgtcggttacattgatctgaaatgggcggaaaagtcctgatcttacagcggaaacatatgccgctctttatccattaaaggagcggcgtgtttcacttttcaatccggaaaggagattgaaaaagtcatgaaccataaaccgaaagcactgcaaaaaggcgacacggtcggtgtgattgcgcccgcaagcccgcctgagagcgggacgctgcaaaccgcgctgcgttttttagagaatgagcttggccttcaagtgaaactcggccgggcgctgaagacccgtcacggctatttggcgggagaggaccgggcgcgtctcgatgatctccatgacatgtttagtgatcagaatgtcaaagcggtgatatgcgcgtgcggaggattcggcacgggccgcattgccgccgacatcgatttcggcttaatccgccgcaatccgaaaattttctggggatacagtgatattacgtttttacataccgccattcatcaaaatacggggctcgtcacatttcacggcccgatgctgagcacggatgtcgggcttgaagacgctgatcccctgacaaaagcgtcgtatcatcagctttttacagaaacggaattcacctatacggaggacatttctcccttagaggtgctgacaggcggaagggccgagggagagcttgcgggcggcaatctgtcgctcattacgtccacgctcggcacgccgtttgaaatcgatacgaaagacaaattgctgtttatcgaggatattgatgaggagccgtatcaaatcgacaaaatgctgaatcaattaaagatggcaggaaaactgtcagatgcagccggaatcctggtctgtgactttcaccaatgcgaaccgaaaaacaaagaaaagtcccttaccttagagcaagtgctgaatgattacattgtcaaatcagggaagcccgcgcttaaaggctttaaaatcggccattgttcaccgagcttcgccgttccgatcggagcccgcgcggttatggatacggcggccaaagcggtaacgattgaatcgggggtttccggaagggagtgatcaggcgtgaagattacagatattcaaacgggacggatgtccgtgccgctgaaaaagccgtttaagaccgctttgcgcacggtttacaatgctgaatcggtcattgtgaagctcacttttgacaacggtctgaccggctggggggaggcgccgccgacggttgtcattacaggcgacagcacggccggtattgaaagcgccgtccacgatgtgctgaagcccgttctctcggggcggagccttttcggcacggaagctgttctgtatgatatcagccggctgttggaaagaaaccaaagcgcaaaagccgcggtggatatggctgtatatgacggatgggcgcagatgcacggacagccgctttaccggcttctcggcggctatcggaatacactggaaacagattttaccgtcagcgtcaattctcctgaggagatggcgggggatgcagaccgttatatgaacaaaggatttcatattttaaaaataaaagtcggcataggtgacatatcggacgatattgcccggattcaggcgatcagatcacgtgtcggcggaaacgtcaaactgagattggacgccaaccaaggctggacgccgaaagaagccgtgactgcgatccgaaagatggaagacgccggcctgggcattgagctggtcgagcagcctgttcataaagacgatatcgccgggctgaagcaggtcacagatgccgtagacacgccgattatggcggatgagagcgtctttaccccccgtcaggcctttcacgtgctgcagacgagaagcgccgatttaatcaatattaagctgatgaaagcgggcggcataaagcaggcggaaacaatcaatgcgatggccgaaacgtgcggcgtggaatgcatggtcggcagcatgattgagaccaagctcggcatcaccgccgcggctcattttgccgcgggcaaacggaatgtgacaaggtttgattttgatgcgccgcttatgctgaaagatgatttgattcaaggcggcatcacatacagcggcagtcagattacgattcccgatgaaccgggtctcggcattaccggtgtgtcgatacaagaggaggcgaaaagatgagagcagccgttacagcggcggcagccaacgtatggacgctgccgtcatctccccgttcggatgatgcgccgatgcttgaaaacccgccgcagatcagaaaatggttagtgtctatgggatataaagagcggctgcaattatgcacagacaaccttgtccaaacgcaagcgcttttcggagaagaagtgatcattctcaaagaggaaggggaatgggcttttgtcgccgttcccggccagccttcaaacaaggacgcgcgcggatatccgggctggatgaaaaaaaaccagctttcaaaagacggctttcatacatcttcccccgccgtatggattaccaaaccgacagctattttatatcacacaaacggcgaaccggacttggaagtaagtttcttaacgcgtcttccggcatcaggacgtgagaaaggctttttccgggtggtgacgcccctcggagaaaggttcgtaaatgaagctgacgcagacgagtgccggcatacggaaggacgggcggccgatgtcatcgaaacgggcatgatgtttctcgggcttccgtatttatggggaggactgagcggtttcgggtttgactgttccgggtttatgtattcgatatttaaagcaaacggctatacccttccccgtgatgcaaaggaccaagcaaaagccgggtgcggcgcggcggtaaacgatatccggccggccgaccttttgtttttcgcctatgaagaaggaaaaggcgcgatccaccatgtcggtttggcgctgggagacggccggatgatgcactccccgaaaacgggaaaaacaatcgaagtgctgtctttggaaggaaccgtctatcaaaaagaattatgcaccgtacgccgctgtataagcgaaaagggggaatagaaaatgacggcatctccgctccttgaagtcagcgggctgaaaatgcattttgacgcaggaagaaagaaagccgtaaaagcagtcgacggtgtcagctttcacattaaaagaggggaaacattcggacttgtcggagaatcgggatgcggtaaatcgacgctcggaagggttattctccgtctgtatgacccgacggccggttcggtatcatatgaagggacggatatacaccgtgccgcggcagaacagcggtcggtcttcttccgcaagctgcagatgattttccaagacccttacgcctcgttaaatccgcgcctgaccgtaagggaaattattatggagccgatggaaatccacaatctttacaatacaagaaaagcccgtctgatgatggcggatgaactgcttgaagctgtcggactccatccggatttcggcagccggtatccccacgaattcagcggcggacagaggcagagaatcgggattgccagagcgctctctctgcatcccgaatttatcgtggcggatgagccgatttccgcgctggatgtgtcggtacaggctcaggtcgtcaaccttttaaaaaggcttcagaaagagaaaggactgacatttttatttatcgcccacgatttatcaatggtcaagcatatcagcgaccggatcggcgtgatgtatttgggccgcatgatggaaattacagaaagcgctgcgctttaccgggaaccgcttcacccttatacgaaggcgcttttatcctcaatcccgattcctgatccgcttcttgaggacaagcgtgaacggattattctgaaaggggagctgccgagcccccttaacccgccgagcggctgtgtattcaggacgcggtgtcctgaagcgatggagctctgcggtaagataacgcctgagcttgaagaagtgaaggcggggcgttttgtcgcctgccatttatacaaaaaagaaagctgacaatataaagtcagctttcttttttgattaaacctgatgcagaaatgacacgcagaccggatacggaaccggaatgtcagattggagcagagtcagtctgcccgtttcggagtcgcgttcaaacaaaaccagatttcccgtttcttcgtttgacgcgacaaggaatgtctcggaagggtcaaacgcgaaatcacgcggccagtttccttctgtcggcacccattcaatcagagacaattcaccggaatattggttgatcttatagatggcgatgctgtcatgtccgcggttggcggcataaagaaatctgccgtctttagatatgcggatcgcgctgccttgcgatttgtccgtaaagccttcaggcaaagcggaaatgacctgcagctctctgaattcacctaaggtcgggttgtattcaagcgcgatgacttcattactgatttccgtcatgacataggcgtatttttccgccggatggaaaacgatgtggcgcggccctgaacccggtgtgaaagagtgagttttcacctctgtgagcgaaccgtttttcatttggtaagtataaagcgtatccgtccctaaatcgacggctgcaatgtagttatgctcaggtgtatagcctgcgaaatgggtatgcggtttctcttgtctttcatgaggacctgttcccgtatgagcggcttcggcagccggctcccgcagacttccgtccttattgacgggaaaggcgtgcacttttccgctgtggtaattagcggttaacacatattcatgtttattatcaatgctgacgtggcatggagacgggccttcaatcagctggtggttcacaaaagttaattccccgctgttctgatgaatctgataggctgcgacaccgccttttccgtctgccttttcaatggaatacagcatgctgttatcagaattcggagtgacgtatgtcgggttgccgagctttgctgccagcttcggacggctgagccgtttcgcttctgtatcaagttcaaaacaataaatgccttcgcttccgccttttgtatatgttcccgcgtatcctatgtacttagccattcggtttccccctttagagtcttgtcttctctatattaacgtatcttgaaggaaactgccttgtaaatgtttaagatgttctgacaagcggcaaggtacagcagcggaaggaaccgcctgatttaataatttcggaaaactcggtttcaatgaccgtataacctctttttctgagctcgcggttcgtatgacggtgctgcggcaggctgataattgtctgattgccgattgacaggatattcgggccgagcgtgaattgctcttcttcaggcacttctatcatctcaaaacgttcggcgagaagatcaatttctttctgccgcaagccatttttgcagtatagcgcttccgtttccgagatcatattaaatacacagtccaaatgtaagaaatcctccttgagagggatcggcacaaccgtcatctccggcagcgcctcctgcagctcccggacagccgctttatccgtgcgcttgctcagcccggcgtaaacggtgccgtctgcgatcaagatgtcgccgccttcaatgttcgcttttttcagtcgcgtataagggattttcttattgtcaagcaggtcttgaaacactttttcttctccctgccggactgaagccgccatgtttgaaataaacgccgtctcgcctaatacaaatccgatatcccgggtgaatacctgctcaggcaatgcggaatcggcaggcagcaggacgacttcaatctgatgagatcttaaaatgtcaataaactcactatgctgtttgagggcaacgggtatgttaatattttcttgtttgaaatgtttctgcgttccgttaataatatccttgatggccatgtgttccggccggcataagatgactgtctgcaaagcatcaaattcactgcggcaagccggtttccgcgtggatttgggaatagatacgtccatgtgatatcctcctatcggtattcaatgtgcgtttattattcccggatgtggtgaataatgaaacatttctgagagaatatctaaccaacttaatatttaaaattttagacaaaacggtcaaagtattgtttaatagggtacagatgaatgagtcaaaacgaccagacaccaaaggggagtttaaataatatgaagttgccagaatcaagattttgcaaagaaacaagggttgttaaaacaagcagggtttttccgcttgatacgaataatcacaatacgctgtttggcggaaagctgatgagctacattgatgatatcgcttcaatttccgcggcccgccactgccggtgtgaaacagtcacggcttcaatggattctgtagattttttgcgccccatcggccaacaggattccgtatgccttgaatcttacgtcacatgggtcggcacatcgtctatggaggtgtttgtcaaagtcattaaagaacatctgatgacgggcgaacgcgagcttgcggcaacgtcgtttctgacctttgtcgcgcttgattcaaacgggaaatcggtacccgttccgcgaatcgtgccggaaaccgaggaagaagtcatgcttcacaatacggccgttcagcgcgccggagaacgaaaaaaccgcttaaaacacagcaaggccctggccgaggcgctcggaacagataaaccttggtaatcgtcaaaccgcttttttaaaaagcggtttttttatgctgagaaaggacttttcctgctggatccataatctattacagggaaaggagacgtggcgtgcatgatggaacataagtcttccggcaccatcctgacaaccgggcgtatccgtctgcggactatgcgggatgacgatgaagaaaatttgtacgggctgtttaccgacagagaggtcatgaaatattatccttctcttaaaagcagacgggaaacgaaggaatggattgcctggaacaaacgattggccgcaggatacggcgtcagtctttggatcgcagaggataaagagacgggcgcatttctcggtcaatgcggaatcgttccgcagacggtaaacggaaacactttgatggaaatcggctatatgtttgcccgccgccactggggctgcggctatgcgacagaggcggcgaacgcctgtctggactacggttttcatacgcagcaatacggacgcatagcggcgctgattgatccggaaaacgctgcctccgtccgtgtcgcggaaaaaatcggtatggtgcccggtgagaccgttaccaaatgggagaggcagctgacggtttttgacatcacatctgacgttgaacgtttcggcgaaatgtagtatgatacgaacagacatgttttctagggttccgcatgttcatacatggcctggtccgagagaaaacacatatgcggacatatcccgcatatgcacacggagggaaaaaagcccgggagagtcaatctcatgtgagacgactatccgggcttttttgtattgtccggatacagaaagggtgaagaacatgaaatggggtttagtggtcatagcggccgtatttgaagtggtgtgggtcaccggcctgaaacatgctgattctgcactggcgtggagcggcacgattacgggaatcatcatcagtttttatctattaatcaaggcgacagacagcctgcccgtaggaacggtatatgcggtctttaccggactcgggacagcgggcacggtgctcagtgaaatcctgcttttcaaagaacaggccgatccggtgaaaatcgtgctgatcggcgttttgctgatcggtgtcatcggattaaagctggtcacacaggataagcctgagacgaaggaggagaaggcgtaatgcattggatcagcctgatagccgcgggtctttgtgaaatgctcggggtcattttaatgaatcaatttcaaaaagaaaagaaagtcaagtggattcttttcattatcgccggatttgcggcttctttttccctgctttcttatgcgatggagacgatcgcgatgggcacggcctatgcgatctggaccggtatcggcacagcgggcggagcattagccggcattcttttctacggcgagcagaaggatgcgaagcgcatctttttcattgcgcttattttatgcgctgccgtagggctgaaaattctttcgtaaattgatttttatcaaatcttcagtataatctattagtaagttacgaattatgaagatacgagggattaaaacagatgaattcatatatgacacagcggctgaaagaataccgccgcgggaatgaggaaaaagggcgcctgcttgtcagctgccccgaccagccgggaattgtatcggccgtgtcggcgtttttgtttgaacatggcgcaaacattattgaatcaaatcaatacacgactgaccctgaaggcggacggttttttcttaggatcgaattcgactgcaagggcattcgtgagaaaaaagaggacttacagcaggcgttcgcctcaatcgcccagacattcggcatgacatggagcctgtctctggcaagtgagctgaagcgagtggcgatctttgtatcgaaggagctgcactgccttcatgaactgatttgggagtggcaaagcggcaatatgatggccgaaattgcggtcgtcatcagcaaccacgaagaggccaaagaagtggtcgaaccgctgaatattccgttccattacatgaaagctaacaaagacatccgcgccgaagtggagcggcgccagcttgagctgctggagcagtataagattgatgtgatcgttcttgcccgctacatgcagattttgacgtctgattttgtatctgcccatccgaatcggattattaacatccaccattcatttctgccggcctttatcggcgctaatccgtataaacgggcttatgagcgcggagtgaaattaatcggcgcgacttctcactatgtgacggacgatcttgacgaagggccgattgttgaacaggatattgaacgcgtcgatcacagagatcacgcagaggatctgaagaatatcggcagaacgattgagcggagcgtgttggcaagagccgtaaaatggcatctggaagaccgcgtcatcgttcacggaaacaaaacgatcgtatttaattaatgacggtccgccggggaggcggactgttttttatggacgaaaatgtcttgacaagaacctgttttctttgcataatataaaaaaatcattgagcgttgaagaggatcagtacgcagaactttctgtgacagagagcaaaatggcccgctgaaacattttgccgcatgaaacctgccgaacctgccttggagtcctgaggggaaaactcaggcgcgataacctggcgttacaggaaagcgggacgcgtgaaaaacgcgttcaaacaaggtggtaccacggaaagcccatttcgtccttatttttcaggacggaatgggctttttttattgacgagagccggtttggattgattgccacggaggagaaatgatgaaaaaacaaagaattgttgtgaaaatcgggagcagctcgctcaccaacagtaatggaagtattgatgaagcaaaaatcaaggaacatacggaagccatttctttattaaaagaaaacgggcatgaagtgatcctcattacctcaggcgcggtggcagcgggtttttccgctctcggctatccgtcgcgacccgttacgataaaaggaaagcaggcagctgccgcagtcggccagacgcttttaatgcagcaatatatggaccatttaaaaagatacggtctgacgccggcacaaattttattaacaagaaatgatttctcaaaaagagagcggtacagaaatgcctatgccactgtaatggaactgttggagcggggcgtcgtgccgattattaatgagaatgattccacatcagtcgaagagctgacgttcggtgataacgacatgctgtcggcgcttgtaagcgggttgattcatgcagaccaattaatgattctcacagacattaacgggctgtacgatgccaatccgaatgaaaacccggacgcaaagcggttcgactatctgaatgacatcacaccagaattgctcgggtatgccggatcagcaggctcaaaggtcggcaccggaggcatgaagtcaaaacttctcgccgcccagaccgctttgtcgctcggggtgaaggtgtttatcggaaccggctccggacgggaaaaactgatgggaattttagacggaaaaggcgacggcacttatatcggcgataaagacctgtcctcagtgaataatacacggcaatggatcatgtttcattcttcgatatcaggggaaatcatcattgatgggggagcggagcaggcgatgatccataacgggtcaagtctcctcccggccggtgtcgccggtgtctgcggcagttttccgaaaggggccgtagtggaagtcagagggcccggcggcattatcggcaaagggcagacgcagtactcatccgatgaaattttagaagccaaagggaagcggagcgaccagctttcaggaacgaagcaggtggaagtgattcacagagatgattgggtgaatttaattgacgagggggaacacaaatgagtgaagtattgcaaaaagcagccttggcaaaagaagcggctgccgaaatggtcatgaaaacgacggctgaaaaaaacgaagcgctccaatgtattgcagacggactcagaaatgaacgccggctgattttaacagagaatcagaaagatattgaagcgggacggaacagaggactgacacctgacattattgacaggctgactcttgatgaaaaacgcctgctcgatatcgcggacgccgtggaactattaatcggtcttgaagatcccgtcggtgaatcgctggagaccattcaaaaagaaaatggattatccattgaaaaaatccgcgtgccccttggagtagtgggcatgatctatgaggccagaccgaacgttaccgtagacgcggcgacactctgcctgaaaaccggaaacgcggttgtgctcagaggaagttcttccgccatccacagcaacatagcgcttgtcagtgtgatgaaacgcgcactggggctgtcaaagcttccgattgatgctgttcagctcatagaagatacaagcaaagaaaccgccaaacagctctttacattaaatgacgggctggatgtattgatcccgcgcggcggtaaaaatttaattgatcttgtggtcagggaatcaaccgtacccgttttagaaaccggagcgggcaattgccacgtgtacatagatgagtcagcagatcctcaaatggcaagcgaggtcgtcatcaatgccaaaacacagcgtccttcggtctgcaacgcgattgaatctcttttgattcatgaaaaatgggccgaagaacacggacgaaagctgctgaatcagctgacagaaaaaggggtggagctccggggagaccaggtgatttgcagactggagcctcaagcgaaacaagcagaagaagccgattggggagcggagtacctggcgccgattctcagtgtgaaaacggtgcaggacgtacaggaggcggtccgccacattcagcagtacggcacaaaccattcagaagccattctgacggagaacgccgagcatgcggcttacttccagaccgccgttgacgccgccgccgtgtatcataatgcttcaacccggtttacggacggttttgaattcggatacggagccgaaatcggcatcagcacgcaaaagcttcacgcgagagggccaatggggcttccggcgttaacatctacaaaaatcatcatcaaaggaaacggacaaatccgcgtataatcttttaagcttatccttcaaaaagggtaggcttttttatgcggaaagattgacggtttctattatattgtgtaatattaaattgtgcacaatataatagaggtgaattcacatgacaaaaccattatttactgcaaccgtatcagccgccggcggacgtgaagggaaagtcacgtcttctgacggagtgctgaatcttgatgttgccatgccgggaacgccaagagcaaaaaagctcgaacatgccacaaaccctgagcagctgtttgccgcaggatattcagcctgctttgacagcgctcttcagctcgtagcaagaaaagagcgtctgagtattgaaacagaggtcactgcgcatgtcagtctgctgaaagatgaagcagaccaaggatataaactaggcgttacgcttgaggtcaaagcatccggcattgataaacaggagcttgaagcccttattcaaaaagcgcacggtgtctgcccgtattcaaaagcgacagcgggaaatattgaagtgaagcttctggcagcagaataaaaataaggatgcccatttggggcatccttattttttgccgtgcagcgtattcaaaacctcataaagcgactgctttaactgctttaattcctcttttgaccgtcccgtctgttccagcatggcaatggggatatccgccgctgttttctgcaaggcccgtccttcatctgtgagcctgatcgtcacggatcgctcgtcttcagccgaccgctttcttatgatgattccgtgctgctccatccgtttcagcatcggtgtcagcgttccggaatccaggtacaaaagctcacccatccgtttcacattcagttcttcgtgctcccataataaaagcagcgccaaatactggggataagttacgttgagcttatcaagcagcggtttgtaccgtttcgtcatttcccttgagcttgcgtacagcaaaaaacaaagctgattctccagtttcatatgttcaaaatctttttctgccattacttctttcaccaactctttgtttgttaacgttacccctattgtagccgaaaaacggtccatttcctattcctcatgtttaaaaatatgagcaggggcaatatatacagtaagtacaatgaggaggctgataataatggcattatttacttcaaaagcgaccgcagtcggcggacgagcaggacatattaaatccgaagacggggtgctggattttgacatcatcatgccgaatgcaaaaaaagacggagaaaccggcacaaaccctgaacagctctttgcggcagggtatgctgcctgcttcgggggagcgcttgagctcgccgcccaaaaacaaaaaatcgacatgacctctgaaattgaaggacaggtcagccttttaaaagatgagagtgacggaggttacaaaatcggcgtaacgctcgtcattgatacaaaagatcttgataaagaaacggcggagaagctggtgcacgccgctcacgagttctgtccgtattcaaaagcaacaagaggaaatgtagacgtcaaacttgaattaaaataaatcaacgaacgaatatcccggattttatatccgggatattttattaacgaaaacatcagtaatgatctcttctctcccggaataagaatacgatatagcacttttgcataatgacaccaagagaaaagagggagaaatcgatgtctcttccaaacataccgaacatcacccccgacattacactctccagatgtgagaccctgaacctccttctttcatccgtggctatggaagaaatcggactatcccatattctgcaggcggaagcggaaaggattcaaatgtttctcggcgcttccggcgatccctccttggaggaattgtcatcaatcaatagaagcactgaacggctcctgcgcaccgtcatgaaatcacaactccttttgcagacgaagcttgaggacattatcttcttacaggattctgaagcctgtatggacccggacgatccaagcaatccgagtaatccgggcgatcctgatgacccgtggaatccggacgacccaagtaatccgagtgatccgggcgatcctgatgacccgtggaatccggacgatcccagtgatccggaagatccatgcgacccgtgctttccgaatccgcatcctgaagatccgtgtgacggcctgttttacggccgcattggctgctgtgagtgcggggattgtgaggactgcggttggaagaaaaaaggcggggagcgttcataaaaaaagagacgggtgaagcatatgccgtatccaagcatctcaaaagcgaaacagacatcttttgaagccatgcattgcctcacgattgcgctgttaaatatattatctgtgaccgtggataaaagaagggattcagattacaaagaagaaatcaggctgttctccgcattgtgccgctggcagatggaaactggcggccgtctgtttttaatggtcagcctggaagaagagcagaagcagatgtatgagcggcactttcatgaaatgaagacagtgacggaacgaacgaaaaaattcatttttgaaagcccgcgcgaattccgggcgcatcccattacgaagcgggctgtcaggcagcttcaggaatgggatgcagaatcaactgccgaacctgccgtcagatgggtgcggcctgtcatcataacgatgaacggcactcctgaacggccttggttcaatcaacaactccaaaatcgggaaaggtgagaaaatgagcggaaatgctgaatgtaaactgactctttgcatgattgtgaaaaacgaggagagatacatctcccgttgtttatcaagtgtacaagacatcgttgatgagatcgtcatcgcagacaccggatcacaagataatacaaaagatatctgcaaaagctttcaggcaagagtgtttgatttcgaatgggagaatgatttcgcaaaggccagaaattacgccctgcagcatgccgaaggagattggattttaatgcttgacgcggatgaagagctcgatcaggagacgggccgttttttaacttcgctgcttcatgatggattaccgagccggggccttttgaaaatcatcaattatacggggaagcagctcgatgaaaacgaagcgtttgaaagcatgcagccgagactgttccgcaatcataaaggccttctgtatcaaggcagaattcacgagaatatctcggcttccaatgaggaagaaaacaatgcttttttcacgctcccatgtgtgattcatcactacggctacttggagcaggaagaaaagatcaagcaaaaacataaacggaatatcagcattttaaatgaagagctttcagaggaaaatcctgatccgtggcttgtctatcatttggcaagtgaatgctacagaataaaagactatgaaaaagcattacatcttgtcaacggctcaatttttcaatttttaagcgaaaaacgaatgcctccgtctctcctgtattatttgaaatatacaatattgcttgagctcaaacggtatgaagaagccgaacaagggattgaaaaagtgctcaagctatatcctgattacagcaatcttcattattataaaggccttgtattatatcatttggaaaagtacagagcggcaatcaaagcatttgaaaacggaacgcaggttgaaggagaaaacgctgatcacttaattttaaaaggtgccgccgatttcagagctttttattatatggcaaaatgccatgctgaattaaaccatgatatgacggccatcgcttacgccaaaaaatccgtgaagttcaatcctcaatttaaacccgcgcaagagcttctgtctcaattaaaaaaggatcagcggacaaacgcctgatccttttttttgcatgtttcattaagataatcgaataatgtttaaagctgcaccgacgcttcctccaagcaatgtggccgcacccaataatccgaacagctgaagctggatggtgctgcctgctggcaaagtcacaataaaggagttattaaagtttgccaaagacgcgaccggggcgataatcgaacttgcaggaggagtgccgttgattaaaatacgcgaacttacaagcaagccggccgttaaattaatatggtaggagatatagtaacgtcccgccggagcaacggtgaatacggtatttgcggcattaaccgttatatccgcagaaaggttttgttcattcggtaaagaaatggtcgtgccgccgacaataactgcgacaacaccgccgcccgtattgcttgcatagccggaagttgctgtcagacttgttccggtgattccggtcggtccggtgccgccagtagcgccggtgcttccagtcggtccggtaacgccagtagcgccggtgattccggtcggtccggtgccgccagtagcgccggtgattccggtcggtccggtaacgccagtagcgccggtgattccggtcggtccggtgccgccagtagcgccggtgattccggtcggtccggtgccgccagtagcgccggtaaatccggtcggtccggtgccgccagtagcgccggtgattcccgccgcagctaaaagtgtatagtcagctgaggctccaggggttcccgccgggctgtttacgtttgcgacgtaagagctgccgttgaaagtaactggctgtccggcggtataggcagcggcggcgaggggatcaaacggtacgatgccttgcagtccggcgcccgtgacccctgtcggcccggtcggccccgcggcggcaagcagtgtataatccggcgatgtcccgggaatgcctgaagggttattgatatttacgacataagaagcaccctcatacaatacaacctgccccgctgtataaaaaggcgcagcagcgggatcaaaagctgtcaatcctgtcaatccggctcctgtagcgcctgttggtccgatcggcccggttgatcctgcggcagctaaaagcgtataatcggcagacgtatccggaatccctgccggcgaaggtgtgttcacgacataggagcttccgttatacaatacaacctgtccgggtgtataagtgggagcaatcagcggattaaaagcaacaatcccttgaagacccgcaccggtgacccccgtcggcccggtcggtccggttggccctgtcgctccggccgggccgattgctcccgtaggtcctgcgggccctccggctggtcccgtcggccccgtagcaccagtcggtcccgccagtgtagggatatttgagatactgtccaattttgaaccgagaagaagctcctgtttcattaagctgtcaagcgtatcccggacgctctcattcaggttcagaatatccgcaagacttgacgggggccctgttaatccgggaatcgttccgagcgcgtattggattttttccccttccgcattcagaatatgtgccattcccagctcttccatagcaattgacgaaagaagaaggttaatggtatcgtctctggaaagtgtaacgacaggggtgatattaggcaaattaggctgtgacacaatgtccctccttatgagttggctgaaaatcattttattacgaacaaagttccccgaaataagcgtaagcagtactgtatcagtatattcactgactctgtccaagtttctgaacgaattcccttcattaaattcatcatatatgaaggaaatactttaaatatagagaaaatacatcgcacagcattcgcaaatcggtcaaaatgacagcgggacatgtgatcgtctataaagcgatggctacatatcttgagcgtttcctgcaaaaactctctttttcatttcaagttttctgtataaaagggcgagaagcatggatggtatcgtacaaacaatcattccgataaaggcataccggggttcaatttcatataaaaaacctccgaaaatagtaaataccgcagtgctccagctgagagcaagcgctgaatatatgccttgggctttcgggatttgcgccggtgaaatattcttaattaagtatttcataaatgcatagtgtcccatcgcgaatgaacaggcatgcagcgtctgcgcaatacagaaaatgatgacatgcggaaaggcaaatacgagtatccagcgtacggtagcaccaagcgccgccagggcgagcaaagagcctgccgtaaattgatgaaagtatcggtcagcgattgcaaagaagataatctccgcgataacggcgatgttgatgatgattccgatggcatatgcgggcgcatcgatttcctgcaaaaagagataaccgtaattgtagtaagatgcatgtgccgcctgcagtaagataacgattgcgagcaccagaccgaaatatttgatgcggaataaggcaaacataccctcttttcttgcgcggtctgtttccggccgttttgaaagaacagctggcgcatgcataaagctgagacatgcgaatatcagggtgcctaaaagcagtgcccataaaatcgcttgatctccgaatatacctgtaaagacggacaggatgacgccggctgaaacaaaacccgcggacccccactggcggcttgtcccataagcctttaattcgttatgctgtacaaggacgccgcaagcgctgtctaaagcaggcattaaagcagggtagaacacatgcagcactaatgtgacaagaagcaggctttgaaaagaatcagcgggaatataacataaaagtgcgagaagcgtcccgattctggcgccgtttaataaggctttgctgctgaattttcctgataaataagggaagaaaaataatgtggaaatccctcttgccgccaagcccaggctcataatgaaactggcttcggatacggaaaccccttttatatgcaccatccatcccgtccaatagggcagaaaaacaccccatgtcataaaaaaactaaaaaaatgcagactcatccagcgatatgctttcattcccgttcctcctttaattggcatgttatcatgtaaagacataaagacaatatgagatatctcatatttttggggtggacgatggaattttataaaggcgagaaaaagcggcatcagttagaaaaacactcaatcgcgcatttattctctttccccgctgaaaagtttatggaagtgcacgaatatgagcgggacgaatggatgattcaagagggcaggaggcctgacttcctgttttacgtgattgaaggaaaagcgaaaatatatgtaacccatcaaaacgggaaagtttctttaattaattttatcaacaaaaatgattacatcggagagatggaactattacatgaagtgtattacacaaaaggaattcaagcctcagcgaagactgtttgttttgctctgcctatttaccgctgccgcgcgcaattgctgcaggatgcgaaattcctgcgtgagttggctaagtttttaagtgctaaggcaacgcttatggcttcgaaatattcacaaagtctggcgttcccgcttgaaaaccggcttgctgattttattttgcagacggcttatgaaggggtttataaagagaagcacgtaacggtctgtgattatttgggtgtatcttaccgtcatctcttgcatgtgctgacgcaattctgccaaaaagggtatttgcaaaaagaagggcggggctatcaaatgaagcagcatgattcattatatgaacttgcagaagcgctgaagaataagtagcacgcccagaaaaaacagccacccgcgatttgcggatggctgttttcattatacaagctgagcttgtttttttcgtgcctgtttcgcggcgtcgaccatattttttaatgccgcaacggtttcttcctgctgtcttgttttcagtccgcagtccgggtttacccagaagcggtcagtcggacacacttcaagtgcgtcatcaataatttgatagatttcttcagttgccggcacacgcgggctgtgaatgtcgtatacaccgagtccgaggcctttcacgtaaggatgttctttcaggtactctaaaaatcctccgtggcttctgctgtgttcgattgtaatgacatccgcgtcaagatcattgatcgtatctacgatatcttcaaagttgctgtaacacatatgcgtatgaatctgtgtctcgtttcgcacagaagatgtcgttaaccggaatgcttctgcggcccaagttaaatattcatcccaatcctgcgtttttaacggcagtccttcgcggagcgcgggttcatccacttggataatctgaataccggcatcttcaagcgcttttacttcttttctgagggcaagcccgatctggaaggcgatttcttttcttgaaatatccacacgcgggaatgaccagtttaagatggtgacaggtcccgtcagcatgcctttcatgtgtttttcagtcagcgattgggcgtagacagtatcttttaccgtcatcggttcgataaattcgacatctccgaaaatgacaggcggacgtacgcagcgtgaaccgtaagactgcacccatgcatatttcgtaaaggcgaatccggccagtttttcaccgaagtattcgaccatatccgtccgctcaaattctccgtgaacgagcacgtctaagccgatttcttcctgaatgtcaacccagcgcttcgtttccgcattaataaaggcttggtactgttcatccgtccaatcttttttccgccatttttgccgtgcgctccgcacctcggcagattgagggaagcttccgattgtcgtcgtcggcagaaggggaagaccgagtgattcattctgcagcgccaatcgttcttcaaagcttgccggacgggagaagtctttttccgtcagctgattcagctcttctttttgagctgagttcgctcctgttgcgaatgcttttaaagccttaagtgccgcttttgattcttcgatctgctcactgacggccgctttgccggacagaagcccttcttttaagacgccgagttccgccagtttttctttagcatatgacaggccgttcagcaaatccttttcaagatgctcgtcagggtgtttcgccaccggcacgtgcagaaggctgcttgaaggctgaatccataactcctcaacatcagcgtggctgaggatatccaaagccgcatcaaggcgttcttcaacatcaattttccaaatgttccggccgtcgaccacaccggctgccagcactttatctttcgggaagccgtgctttttcaattgctcaaggtttctgcctttatcatgcacgaaatcaagtccaattccctgtacaggataagaaacgagttcttcatatgcatcaaccgaatcgaagtatgtctgcaggaggacattcagtcctgaaagctcttttgtgatcgcttcatagaggtctttggcggcgcggacgtcttcagaagaagctgtcacaagggccggctcatcaatctgaacccatttgacgccttctgcttcaagttctttcagcagctgcacataaagaggaacaaggcgtttttgaatcgctttcgcttctgattcttcgtatcctttcgcaagcgtgacgaatgtatacggaccgacgatgacaggtttcgtttccgctccgaattcttctttgatccggcggtagtcgtcaagctgtttgtttctcgtcagacggaattcaatgctttcgtcatattcaggaacgatgtaatggtagttggtattgaaccatttcgtcatttcactggaaacggcgtcttttacaccgcgggcaatcgcaaagtatgtatcaacgggatccgtgatgctgcggaatctttccggaatccagttaaagctgacggcggtatcaagcacatggtcataatgagtgaaatcagagaccggcacgatatcgatatgttggtcaagctgggttttgacagctgataagaataagccgtcaagctctttaagaaacgtttctttatcagtgtttcctttccaataagcctcaagcgcttttttccattctctgttcaagccgattctcggaaaaccgaggttcgaagttttgattgttgtcattaagtctcctcctttaagtgagatgtaacaaaaaagcccctttctcatgagagaaagaggctttaacttcaaaatgtaagcctctctcatctctcagatcacgtctgatggaattagcaccgtgccttatgagacagtcgtctcggcgcaaaaatcacgcgccccatttcacaatggaattacggtcggttgctgttggggtcaaaaggccaatccctcgcccaactctcgataagagaaagtatttcaatttttttgaaaagttacatcatttgttggttatcttatcagcttattcagatcactgtcaatagaaaatctcacattttaaaaattggtgatgtgacaagctgaccattcattatatgagaaaaatatcagaaagacagcagctgtgcctgttcggctctttccatcagcacttcaggcgcgtctaaatacagaaacccgttcccggccaatgttttggcgatgtccaaaggaagggtccgccgcacgagctgggcgtagacttcagcctcagaaagcgtccgctgaaacgcgtcctgttcaagcccttttattaaggcaagcgctccgctcacatgcggggcggccattgaagtgcccgtcagcttcccgtatttatggttgggaagggtggagagaatattttctcccggagccaccaggtcaatctctttattggcgtttgaaaattcagacgatttacgggcgattgagactgatccgactgcgatcacttcgttgtaagcggccggatacgacagttcctctgtacgctcgtctccgtcgccttcgtttcctgccgcgcaaacgaccagaacaccgctttttaccgcatttgcgacggcttctttcaattcaggcacatcgcttggcccgccgagtgacatggaaatgatatcggccttttgttcaacggcgtagttgatgccgttaatgatccattcgtatttgccgctgccgttttgaccgccgagaactttaacaattaagaggcttgcttccggcgcgacacccgaaattccgccgtttgaatcattggcggcaatcgttccggaaacgtgtgtcccgtgtccgttataatcggaaatcgcgtcttctttgcctccgtcatcatcggtgaagtttttcccgccgacaatccgatctttcaaatcaggatgattgatgtcgcagcctgtgtcaagcaccgcgattttaatatccttgcctttaaacccttttgcccacaactctggcgccttaatcactttaataccctctggaagctcgttcacatccatgatctgttcatccgtgacataaggaatcaaatgcatttcaccattcataaaaaagccctccttttttatgcttgcgagtggatacaagggtgttgctactattttatggcagagcatgccggccggaaagagtcatttgaagcattttcataaaaaaggcgtaatctattgcactaaaaaatttcaaataaatggatagtttaacagcttttattttcattcatgacccgctgacgctataattggaaatgggaaaggagaagagatatgaagataaatgaagcattatacgactattttacagaacaagcggatcaaattgcgaaagagtggatcgaaacgatggaagattcggacccgaattcgatttattctttgacaaaccccgtcatcacagaagaactgacggagcaggataaagaattttaccggcatattaataaaatgtatatcatgccggaaaaagaatttttagaagagttcgagcggtgggtgattgagcttgcgaaagaccagaagcatctggatactcccgtccagtatgtggtccgtgaattcatgagaaaccggagattatacatcacttattatgatgcgtttgccgataaacatgaatcttcgtttgcacagggagaaaggaagaaatgggagaatttaattgtacgagtatttgattttacgatttacacgtttgtcgatcatgccgagcataactcgaaaatgcagctgaacgcgcaaagagaaatgattttggagttaagctcgccggttatcacgctgagcaaacggacggcgctgctgccgcttgtcggcgatattgacacggagcgcgccaaattcattcttgaaaatacgctgagcacatgtgccaaacggctgattgaacatctgtttattgacctgtcgggtgtagtggttgtcgatacgatggtggcgcatcagatttttaaattaattgaggcgctgaaattgatcggcgtcacgtccactttatccggaatcaggccggaaatcgctcaaaccgccgtacagctcggcattaatttctcagatattacgatcaagtccaatctcgctcaggctctcaattatcaccaataacatacataacaaaacaggctgccgaatcactccggcggcctgtttttatacaaacaacaatgaaatgagccagcttgcgccgaataacagaagcacgagcaggaaaaagcaccagtcggcgcggcgcacggtaacagttctgtaaaacgtgcggtttcggctccccgtaaagcctttagattccatcgcgatcgccgtgcgttccgcctttctgattgcgcctgccaatagcggaatggtgaagcgcctgacggcggagagctttcctttcagcccggaatcagacgccgcgcccctgattctgtgcgcctgccggatgatcaggatttcatctttcagaagagggagaaaccggaaccccgcgataacgccgtatgcaagcttgggcggcagcttacactgctgaatcagactgagcatgaacagaatcggatcggttgtgaaaagaaacatcatcgacaaagcggaaaaacataaaatacgaaacgcgatagaaatcccgagcgccgcgttatcactgttgacggcaatcggcccgagcttaaacagcaggttgcttccggttgtcgggacgtttccgaatacggcggctgtccataaagaaccgaaggccagaatgacaaacggaatcgtgaacagcagccattttttcagcggcacacgccccgccgagaggacgcctcccgcaatgatgatataaaacaaagcaggggtgtacggattataaataaacgacagcataatgacgcataacaatacagccgccgcctttattgacgggttaacagcctccagccgcaagttcatttctccgcctcctgtcgtgtttcatccattcataccgcagcggcaaagccaaatgcgcctgctcggcgatcccggtgttatcagaaaataaagcgtcgggagttccccggaataccagtttcgtgccgcagagcacaaggatcgtgtcggcataatctgagacgagttccatatcgtgtgtcaccatcaaaacagccgttccttccttttgaatctcacggagcatttgcatacactcccgcgccgttttggcatcctgtccgaaagtcggttcatcaagcatcaaaacgttcacattgtgcataagcattgtcgcgacactgagccggcgtttttgtccttggcttaaagaaaacggatgctgtgaggcatggcgtctcaggccgaatcgggttaacagctgaagagctttctcctttgcgggtctgctgctttcaaaaccgaacatcagctcttgaatgacagaatctgtgacaaattggtgttcaggattttggaaaacatatccggtcagccgccgcagctctttttcagaataggaatcaatcggtctgccgtctattttgatgtctccgcccagcggacggatgagcttggccgcggcagaaaggagcgtggattttcctgttccgttagggccggcaatcgcggtgattgaacctttttttacggaaaagctcacatcctgaaaaatgacgtctgctcctcttgagaatgacagctcgtgaacgctcagcgcgtcttctgccgaaagcgcggcgggccggggttcgggcagagatggtataggttcgtgaaacagattttctttacacaatgtaaaaggaatgctgacgtgctcctgcaatgagatcacacgcggaatcggaatgccgagctgcatcagctcttcaatctttgtttcaaagataacgtccgtctctccgtccatcaccttctgacccgtttcgtcaaggacaatcgtcctgtccatccacggcgcccaatgatcaagctgatgttcgataacgagaaggccgaagcctttttttgcttgtagatctttgatcagccgcactaattcacgtgcggaatatggatcaagctgtgccgtcggttcgtccaaaataatgagttccggttccatcgcaatgatacaggcaagcgccactttttgttttgaaccgcctgacagcgaagcgatcgttcgcgttttcagatgagtgatctctaatttttctaaaacgtcatcgatgattgcgtccatatcttcttttgtatattgcaaattttccaagccgaaggcgatttcatcttcaaccgtcagcatgcaaaactgctggtccggatcttgaaacacgacgccgatggacctggcggcgggttctgtcagatgtgaaagaggtgttccgtataaagaaacggttcccgattgaaccccatcacatgcttccgggtacagaccgtttaaacagagagcgagcgagcttttgccgcatccgctcggcccgagcaataaagcccgctctcctttgcggagctgaaaggacacgttttgaagaatcggcttttcatcctgatcataagaaaaggtaagacagccggccgatagaaggggctcagatgcctgcatcttggttcacctgtttctttttcttcttgaattgttttccgagcgccatgccgttcagcacccctgtgtaagccagcgcatcactgattgctttgccgagaaggccggcaagaagcgcacctgagatcagacggacaagaagcatgacggctaataaacccggattcaaaacagagtatccggaaacgaacaagtcataaatgaagctcgtcacagaagaccccataccggataaaagaagcacgggcagggtataaatccgccagcgtgtcgcaaaaaagaccgcttccgcaccgattccctgtgcgatcccgatcagaatcaccatcggtcctgacggatttccgagtaagcactccacaaacgcggcgatgatttcagaaacaagagccgctcccggtttttgaataatgtacgcggcaattaccgagacgataaaccagataccgtaaatcggttcgtagctcatccggccgaaaaaccctgccgctatattgcttgcatgagttgatactaaataaatgacagcaaatacaacactgatgacggacatgacgacaatttctctcattttccaatttttcattgtgatctcctgctttcttatcggatagtcgtatgtatgaaagagatgattttacaggcggtttatattcagtttcatattgcggtgtcctcccccgttttttaatgaaaaataaaaaactgcatatccgagggaatatgcagcagcagaacgaaaacgcatggggaaaaaccctgcgctccggtcaatctgcacttccccacgctggtattatccagatcgggttataagggatcaaaacacgcctgccgcatgttttatctcagccgataacagcacccctagtgcgtttcctatacagttttttatgatgatatcatcatagttgatcatgtctgatttgtaaacagcctttctccaaacagagtttggaatcggaccggatgatcattcataaagataagaagagcccttttgatcaaaaggaaacggaggacatctatgtttgttcatacagtgcagtctggcgactcgttattttccatcagcagaaagtacggataccctgttgacagcatcagaagcgtcaacgggcttgaggaaacgaatatcgttccggggcaggcgcttttaatccctcttaatgaatatacggttcagccgaatgatacgtatgccgttatcgcaggtaaggcttatgtgccgcagatgcagctgatgcaggcaaacccggatattccgccgaaccggctgcgggcgggtatgaaagtgaagatccctgatatctctaactatcttgcgggaaccctgcaattttatgtcattcggacgcctgaagcggatagagagttaattaatgattttgcgccgtattcttcggcgatttctttgtttgaatatcattttggaccgaacggagatatcatgaacgatttaaacgacagaaccgcaatagaaaccacatggcagaacagagtgcgcccgcttgccgtcattacgaatctgacagaagggggattcagtccggaattagcccatcaagtgctgcaaaatccgacggcacgaacgaatctcgtcaacaatatcgtctccttaaccgtaagaaggggatacggcggtgtaaatatcgattttgaacgggtcagagaagctgacagggacctcttcacaggatttctccggcagttaaaaacccggctttcagagcatcagctcgcgttaacgatatcggttccggcaaaaacaagtgatgcagtgccgtggctgaggggatatgattacggcggaatcggagccgtcgtcgattatatgttcattatggcgtacgactggcaccacgccggcagtgagccgggacccgtggcgcctttgacagaggtcaggcaaacgatcaattttgccatcagcagggtgccgagaagaaaagtgattctcggtgttccgctgtacgggtatgattgggtgattccgtcccgtcccggaacgatcggatccgccatctccaatcagcgcgccatggaaacggccatgaagcatcaatcagtgatccgttattcccggcaggagcgttccccttacttccggtatactgatgaaaatggaagaacgcatgaagtgtggtttgaggatgtgcggagcatgagtgaaaaaatggttctcgttcgggagttcggactgcaggcgatcggcgcgtggcaattaacgctcggtttcaaaccgggcccgtggctgcttaggaactttttcacgatccgaaaaatatagctgcatgtcccgctccgcaagtgattttttctttcctatgataacgggtcttcttttggacaatctaaaattgaacaggaggtctgccatatgaagaaaagggaagagcagtatatcaacgaggctgagtatgtaccgcatcctacaaaagaaggggagtacgcgctcatgctgcatgaatcctatcatttcctttcagaagaggatgaaagcgatttgccggaataagggctttatgcctttattccgtttattttataggcaagtgctgaaatcacaaatttaaggttgacacattccttttttttctgtaatctcagtgtgtcaattcaaataagaacttcgttaggtgaggctcctgtatggagatacgctgctgcccaaaaatgtccaaagacgccaatgggtcaacaggaatcatcgacataaggtgattcttaacgcagctggatggctgtcctatgccatacagtgctaaagctctacgattggaggccccgcacgtttatttgccgtgcttgttttcgccttcatatcggaaggttttttttatgcctcaaaacgtacacgactgagcatgataaggaggtgcggagtatggattctccccattcgagtatgtcagaagaagtacccatatacagccagataaccagtgacgacatgatgaggagacagaccgccgcacttcccttgacggacggcgcgtctccgtaaaggaggtacgagtcccgatggtccaaaacatgacctatgacgaactcatattacgcattatcattttattgcgggacggaaaaataaaagaattccgaaacatgatagatgagcttcagccctatgacatggcatttttgtttaaagaaatgccggaaaagcaccgggcccgctatctgtcatatatgacggttgatgacatcaccgacatgatcggagagctggagcgggaatttcagcttgccgttttgcataaagtcggtaaaacgaaagccactctcgcaatgaataaaatggataacgacgatctcgccgcattgctggaagagatggatgaagaactgaaagaacagcttttatccagcatggaggctgaggaatcaaaggccgtacagcttttgatgaactatccgcaagaatcggcgggccggatgatgacgaaccgcttcgtctggattccgcagcattatacagtaaaagatgcggtcgtgaagctgaaaagctttgcagaaatcgcagaatcaataaattatttgtacgtgattaatgacagcaagcagcttgtcggagtgctctcttacagagatttaattctcggcgagcctgaggataaagtgcaggatctcatgtttacgcgtgtcatctcggccggggtgctccaagaccaggaagaagtcgcccggctgatccagcggtatgactttttagccattccgatcgtggaagaaaatcatgtgcttgtcggtattgtcacagtcgatgatattattgacgtcgtgattaaagaagccgatgaagattacgaaaaattcgcagcctccggtaaggcgattacatttgatacgaaagcgtacgttgcagcgtaccgccgtttgccgtggctcattctgcttttgtttatcggattgatttccggaagcattctgaattattttgaagatacattgcaaaaagtagtcgccctcgcatttttcatgccgatgattgcgggaacgacgggtaatacaggcacacagtcactcgccgtcgtcatcagaggactggctaaagaagaaatgaataaaaaaaccatctttaaactgattttccgtgaattaagaaccggaatctatatcggcatcgtctgtgcgatcgcgattacgattgtcgcaaccgtctggcagaaagacttaacgctcggttttgtcgtcggttcatcgctgcttgcaacgttgattatcggtacgatggccggaacgatcgtccctattattcttcataaactgaacattgacccggcgattgcatcaggaccgctgattacgacgctgaacgatattttgtccttattaatttatttcggcattgcaactgcatttcttcatgctttataaaaaaagtccgtctcacaggaggcggactttttttatcagcggtttttatacttaaaatgagcattaagctgtccttccagcatttttttgcggagctgcgggtcgtttttgagagcctgttctttttttcgcatgtcttttaaaatctcagccgtctgcacgccgtcttcccgcttgttggcaatatccatcagccgctcaacgtccgcgaaggaatactttctcgttccccgtgatgatcgctgcgggtagattaatttccgttcttcatagtatctgatctgtctgactgacaatccggttaattcgcttacaatgccgatcgagattacttttttatctttgtaagattgttcgtctgccgtcatttttccacccctggatgtcttttactcatattatataagaaaaaaagagaaaaaacctgacgcttgtcaggttttctgacgcggaatagaaaattttagaaaaaaagcggcagaaaaattgacaaggttaatgcatggtcctttgccccgttttatgcttactgtacagacacaatgaggaggaaggataggaatggagaaagaaaaagcggtttcgctggcaaaagaaatcattgaattagatatgaaacgcgatgaaatgctggaggcgttcatgcagcttgccggggaacatgcttttccgctgctcagagccgtccagaacggactttaccgaaaaacatcataatcctacagaagttttacaatggctttatacgtctttgatataaaagcgttattctgatcatagaataacggaaaacaaaggaggccgccatgagtcatttgcttcaaaatgcattggacaaagagagaaaccattattccaaaaagcttcttcagatcggagtctatacgaaagaaatactcaattccatgacaattacggagctgagaaaggaatacgcgtatttttttcggaacattccctataaagaacggaacccttatacaaattaaatgatgtataagggtatttttttatataaaaaagaaggaattctgaaaaacggcacgaatagaatataaaacaaagaacgactcttatgaattgtaagggtttacattatttttttataaaaatcttaaatacggggtagatatgatgagattatcatttaacgaagaagaagtgatgcgttcgatgaatttgtacaaagtttttgcaagggctttcaagagtgtgtctgaacacagcatccgcgacagtaaagaacacggttttaatccgactgaatttgccgttttggagctgctctatacgagaggaccgcaaaagcttcagcaaatcgggtcgcgtcttttgcttgtcagcgggaatgtcacctatgtcatcgacaagcttgaaagaaacgggtttttggtcagagaacaagacccgaaggacaaacggtctgtttacgcccatttaactgataaaggaaacgagtatttggataaaatttatccgattcattcattgagaattgcgagagcgttttcaggacttatgcctgaggaacaggaacagctgatagccttactgaaaaaagcgggaattcacagccagcatttgcttttccgttaaaagaaagcggatacaaacactcttcttcaggaagagtgtttttttctgttccggacagtagagcctgaagcggtttttgcataagctgatacaggtcggcatcattatttaccaatcataatgtgacatgccccatgccaaaatatgagggtgctttgaatataaagaaggtgaacatgtgagaagctgtctgctgtctatatggtacttacttgatccgctttatttcttctttacccggctgacgctgattgataaacggcaatcgaatgtattccgcgtccgtttgacaagatataaaggaaaagaagtcatcctgagcgacggaaccagaattaaaaaaaacgacgtgttagttaagattcatcttcataatgtcaaactcctgaaagagctgcagcctattgaaagcgcggtcagaagggggattatgctatatcagaaggtatatcaatccatgcctcatttagcggattatattaaccagcataaacggaaagacgagattaagggagtcgtcggcattacaatgcttcataaaggagcggcgagactcggttttgatgtgataaaaccgtccagcggctgctacaggctgtttaagaaagcggcccatattccgattttatactttactgcaaaacagctcaccctcaaaaacattccttactcctgctatttatttatttccaaagaaaaattgatgtgcacgtatcagactgaaaagagctgacaaaaagcgtcagctctttctcttgatttgctcaagcacgattgaaagcgggccgtcctgcggattccggtaaaaatcataaaacggatctccctctgtcctgacgcggttcactactgtatcgatcgtataatcatcaggtgttaaagaggagttgacttcgctccaataaaggggagccgcaaccgttcccaattcgttgccccgggtcgaatagggggcgataatggttttcccttcggcatgctgcaagtaatctaggtagagcctgccgtttcggtttttgataaaccgctctgtcgtaaaaagatccgggcgcgtcctgacgcaataatcggcgatgagcattgtgaacgcacgggtttcttcataggtgaatgcttccggtgaaagcgggatatagagctgaatgcctttatttccggagagcttcgggaatgacgtaatgctgaatgagtcaaacagctgtttcagcacatgcgcagcctccactgccatgggaaaatcattccttgacggaggatcaaggtcaatgacgatttctgcgggcctttcagaatgaactttctgaaacggaacgtgaaattcaagcgccagctgattagccagccatagaagtgacggtatgctgctgcatacgatgtgctcgtggctcccgtcaaacacgcttgagacaaagtccggcgtgtagtccggtttgtttttttgaaaaaaagattcgccaggcgcgccgtgcggataacggatcaccgtgacggcccgatctttaagaaagggcataagaaaatcgctcattttcaccatataactaaggaaatctgctttcgttttttcacgttttttaaaaacgatcttatccaggcttgtgaactgcagcttcggcggcagcgttttagagcggaggataagctgctgatacgtgcattccgtccaatccatttcaaactgaaaagacacaaaagatacttcacgcagcgtgtcctgcaatatggttaaatactgcacggtcatgcagatagaaggctcaagtgtatactcgccgcttttttgtttttttccgtgggtctccataatggttctgacggcgtttttttcttccgcctgcatgccgtgggaaacggaagcgatcgggatggcggtgccgtcttttaaaacagaggctgttacatacccgttcttcggattaaacccggttaatagcacatgtgccgttttcatatgtttatacttttgccagtcgggagagcgtttattttccgcccagccgcttgatgctctttttgctacgataccttctccgtcatggcggacgaccttgtcccaaagcgcatcaaagtcagtgtgttccggaatgtattgaatcgcttcttccgctaagtgatgagggcaggctggaagatttgcttctttaagcagtttggaaagggcgcgtttccgtttcacatacggtaatgaaacggtgcccgcgccttccagaacgaggagatcaaatgccagaaagcggcacggccgtctatcagcggtgctttcaattgcttccgtccgttttaaacgtccgcggatttgaagatgctcaaagtccgctctgtacggattgattaaatagacaagctctccgtcaagcgtaatggggaacctgtctttcatgtgctgaaaacaccgagccgcaaaagctgtgatttccggaaattgattcgtcagcgtctgtccgtttctgctggttaatgtaacgccgctttcgtctatgcggagaagacagcggaacccgtcatactttacctcatagcgccactcactgccttcaggcggtacagaggtcaaaatcggctgcatcgtcagcaccatgattaagacgttccggctttttgtctggtcgtcttctgctttttgcctccgccgcctgctgacgcggcgtcttttggccgcgccggtgcagcctgttcgcgatccggccgcttcgtccggtcaatgcttgcctgaagcgcgctgacaagatcgatgacatcttcgcgcgggccggcagcagccggtgtcacgcccgcttcttcatgttcgagcttatcgttaattttagcgagaagggctttccggtatgtgtcttcgtattgttccgggtcaaactcggttgtcagctcattaattaacgtaatcgccgtctgcagctctttttcattaacggctgtctgctcgggaacgcccggcacatgtccggcatttctgacttcatccggataatgaatggattccatcacgatgcagttgtcatacacgcgaagaatcgcaagctgctgtttagagcggatcgtaatggaggcaatcccgattttacccgtcgtcctcagcgcttctcgcagaagtgtataggcttttgtgccgttatctcccggcccgacataatatgaccggttaaaataaatcggatcaatttcctgcagctggacaaagtcaacaatctcaaccgctttttcttcatgttcctgttttacgtctttcaagtcttcgtctgtcataatgacgtatttcccttttacatactcatagcctttcacgatttcatcaggttccagacttttttcacatccggtgcagattttctcgtatttaatcggcgcatggtcttctttatgaagactgcggaattttatatctttatcttcagtggccgcaaagagcttgaccgggatattgacgaggccgaaactgatcgaacccttccacatcgtgtgcatgaataaaaactcctttttgtctttattgtggataaacgggtccgttccatgtgtagcaacttatgggtgttgcggcgcttcatggagcggctgttccatttcctcaggcggaaatggtcggctgaaaaggaaatgaattctttatttacaatcagtgaatcggtaagttctttaaagcgctgaagtccctgaaaatcatcagcggtaatcaaaaagattatacaaaatcattccccgggaaatgcccacgcattcccatgtggtgactgagaaaatttcccgctcccatatgaactgaatccgcggtcagccgccgcttacttttcgggagatcttaagtgatgtaaacgccgccagacaagcaatcaggagacaggcgggacgttgtattgcgcatgtcattccctcccgctataccgatctgaaacgactcacatttataaagggcatgtctaaaagatatttcagcctcaaggttttgtgttaaaatcattcttaagtttcggaatatagacgtaagccgggagtgatagatcatcgaagatttcatcatatcaataatagaggcgtttaaaagcttatcttatgccggaatttttttggcgctcagtatagaattcatcccggcggaaattgttcttccgcttgcgggctattgggtctcaaaaggggatatgacacttgccgggaccgtgtttgccggttcgctcggcggtgtttcaggcccgcttgtcttatatggaatcggcaggctgggcggtcggccgtttttgctgaaatatggaaagtatatatggataaaacccgaatccctgcagaaatcagatgatttctttcagaagcacggaggtttggtcgcgttcagcggccgttttataccgggggtcatgacgctgatttctttgccgtgcggcattgcgaagatgaatgtctgggtgttctctctatatacatatgcggcgatgctgccgattacatttgcttacgtatacctcggaatgaaactcggggaaaattggaaaagcgtcggttccattctcgatcaatatatgctgccgctcggtatattcattgtgttgcttctcattctttggatgtttttaaagagaagaaaacagcgggccaaaacagaaaaaatttctcaatttgttaaaaaagttaagcgttgacaaatgatgaaacaggctttatcatgagcgtataaacaaatatttcttgaaatcccaaaggggagtagcgtccggatattccggaaacaaagtcgtcaattcatggatcatatccatcggctttgttggcatgccaatcattcatgtctagcaagacctttgccttatatcggcaaaggtcttttttgcgtaaaaaaaccgccggtataagctcggatgatagaaaaaagaaacggagggaatggattggactttgcattattattggagtatggatgggttcttctcgttttaatcgggctggaagggattttggcggcggataacgcgctggtgatggctgtgatggtgaagcatcttcctgaaaaacaaaggaagaaggctttattttacggattggcgggcgcatttattttgcgtttcgggtcgctgttcgccatttcttttctggtgaatgtttggcaggtccaggccgtcggcgctttatatctgttttacattgcggtcagccatttgctgaagcggtatgtatttaaagataacgccggtgagaaaatgcagaaagaaagcgggttttggcagactgtcttgaaagtggagctcgcggacatcgcttttgccgttgactccattttagctgcggtcgcgcttgccgtaacactcccgggaacagagcttcctgccatcggcggcttggacggcggtcagtttctcgttattttagccggcggcgtaatcggtttaatcattatgcgttttgcggcatcaatgttcgtatccttactgaaaaccaggccgggccttgaaacggcggcatttgtgattgtcggatgggtaggcgtaaagctcgctctttatacattggcccatgaggaactcggtataattccggcagatgtcatccattcggcggcctggaaaatcattttctgggcggttctggctgccatcgcggtttgcggatggtttatgtcaggagcaaaacaaatagagtctggcgcggaatcggaaaaaagagaacacgcgtaaaatgatcaaaaagggagtctggctttttaaaaagcaggttcccttttttgtttgaaacgcttacatttaagacatatgataacaattttataacagcattgttacaaaaaacacagagaaaacccccttaattctgcatgggggcacgaaatcatgtatagtacgtcttattggcttgtcataattgagacaaatgaaatcgatttctctttttcttcctttgcgaatccctactaaattagctatgattatgagtagttatagggaggaactgaggtgaaaccagtgcttagccttttgtttaaattgggaaaaaagaagcaaacgcttgaaacatctgttgaaaaaatacaaaaaggcgacaaagatctgcagaacgatttaatacagcaatataagccttttatcgcgaagacggtttcatccgtttgtaaacgatatatagatgaaaaagacgacgaattcagcatcgggctgatcgcgtttaacgaagccattgaaaagtattcggctgaaaaaggtaattcgctgcttgcatttgcagagctgattataaaaagaaaagtgatagactatatcagaaaagaagcaagaaccgctcagcatatcaatatggatgtgcaggaaggcgacgaccaggaatcttcgcagagccttatcgaagcggagctttccattgatgaataccgcaaacagatagagcaggaacagcgccgggaagaaattcttttttttcagaagcagctcaaagaatacgggctgtcttttaaagagctgctggaacaatcgccgaagcatacagatgcgaggcagaatgcgattaaggtagcctacacgcttgttgaaaatgaagagctggcgtccattttgcaccagaaaaaacagcttcctgtcaaacagctggagcagctcgtgtcggtcagtagaaaaacgatcgaacggaaccgaaaatatatcatcgccatgagtattattattaccggtgattatatttatttaaaagattatcttaaaggggtgttgcactcatgagaagagggatcatagtagagaaaaataaaaaattcgtcacgttgctaacccctgacggacaatttttaaaaacaaaaaatgatcaccgcacttgtgaaatcggagaggaaattacgttcgaaggcgaaacgcgtatgggaagaagggccagcttttttgattttctgaaactgcgcccttttaaattgggagtgtttacgatgactgctattattttgtttattttaattttgctcccggttttttcggataacaaagcttacgcgtatatgacgcttgacattaatcccagtattgaaatggctttaaacagcaaatatgaagtcattgaactgacaccgctgaaccatgacgccaaacaggtcatcagtgacatcggagattggaaaagcagcgattttaaggaagtcatcagtaatattattaccgattgcagcaagcatggatatgtaaaggaatcaaaagagattttaatttccacggtttatgaaaatacagatgacaatacatataaaaaaggcgttaaaaaacagctggccgacatgactgaaaaatataagggcacctaccaggtccaatcgcttgaatctgatatggaaacaagagaaaaagcaaaacaggaaggggtgtcaacaggcagctacataagaagaaacgaaaagaaaacagaagaaaaacagcctgaaaagcaaaccgacggcaatgaaacagatcaaaaagataccgaaacagacgctgatcaaagcgagcagccggacacagataagccggcggctgatgaaaagacagctcctgatgaagaaaaggcagcagagaagccgggaaataatgaaacaacgcccggtacggaagaagcgaagccggacagtcaggacggcaatcagcaaaccgaaaaaaatgcagcttccggatcagaggaaaacacacagaaggaacaagatggggaaacagagcagcccccaacacaaaatcctcaggaaaacggaaatgacaaagagcctaagcaaaagtattacaatcattactggaatcatgatcgcaatgaacattgggaatcctatcggcatcatgaagattcgtcagaccgaaggaatccgaacggctaccggcacggaaaggagaatgccgataaatatcaaaattcgccgagaagtcccggcgaataagctgcattattgatttttcccgtttaattgtgattgagcctgctgtacaagacgttttgtcatttccccgcctacagagccgtttgcgcgtgctgctgtatcagagctaaggttcacgccgaattcttgagccacttcgtatttaaattggtcaagtgcctgctcagcccctggaactaagagtttatttctgctcgccatctttttcatctccttttctctggcaagatgtgttttcgcattttagtttcaaacggaacggtattgattatgctggcaattgttgtacagcaaaaaaaccccggcgcagacaccggggcgaagaagcgttatgaattataataaatggctgatcattttgtaggctgaggcttgaatatggaaagtcaaaacggagagcaccgtgacggcgattatggatctgatattgttccattgtccgcttccgagttctttaaagcagcctttgagcttgtccgtctgctcttcgacgagctcctgcaggctcgtttccttcatcggcgggtttgccttatgatgaagataatcaatcacttgggcgcagctttcatagtagctgatcgggctgatgacgtcgtctgatctgtctgtgatcgtgttaaaagcaatttttaatatgccgcgtatatgttcgaagtcataaattgattttaaatcacgtacaatgagaaggatgacagcttgttcaattgtatattttttgccgagtaaggggtggccgattaaatctttaatatcgcgcttcacccagttttggacggcggttgattttaaagacgtcagctcgcacagatttcccagctcgacaatctcgttagttgaaagcccgtattcctttttctctttttttcgttcgaatctcgtcagaaattcagggatatgcagacggctttccgcttcatccaaggtcatatccgctgattgcaataagatttggagaggagttgcgtctccttggccttttaacgcgtaaagaagccggaccatatcagttcgggtcagtttaaacgtgttcatggttcacctctgattgattacgtgttcactttttaatatcactgagaattacattaacatcatacgtcgaaattgttgcattttcaaacagatcatttataatttaagtaaataagttcttttgatcttaaaaaagacggaggtaattatggcgaaaagaatatttctgtttattttaacgaaccttttggtcattacgacaatcggaattgtgcttacgattattacaagcgttaccggtgtcggctcgtatatacaaaatggccgcattgatctgatggcattgctcgtgttcagtcttgtcgtcggttttgtcggttcttttatttctctcggaatgtccagatggatggccaaaacgatgatgggcgtccgggtgttaaatccgaagaaacagtcgctcagctatgaagagcagcaattggttgaccgtgtgcacagattgtcacgtgccgcagggatgacgaaaatgcctgaagtcggcatttatcattccccggaggtcaatgcttttgcgaccgggccttctaagcgccgttcgcttgtcgcggtttcttcaggtttattgcagcagatggatgatgctgcggtggaaggggttcttgcccatgaagtcgcacacatcacaaacggtgatatggtcacgatgacgctgctgcagggaatcgtcaatacgttcgtcgtattcctttcccgaatcgcggcatgggttgcaagccgctttgtcaaagaagacctcgcaccggtcgttcattttatcgcgatgatcgtgtttcagattatcttttccattctcggcagtcttgtcgtcttcgcctactcgcgccacagagagtttcacgctgaccgcggcggtgcagaccttgccggcaaggataaaatgattcacgccctgcgtacgctgaagtcttatacaggacatgtgaatgaagaagaccagacggcagtgcagacgttaaaaattaacggcaaaaagcattcgtcattgttctccacacaccctgatctcgatgagcgcattcgcaggctggaagcaaaataatcaacaaaacctctgacaatcgtttcagaggttttttgtttaaagatcggcaaactacataaggtaatgaaaaatctttctaaaaagacctttaaaaattctcccaatatcattagaataattacgtactacatttgagaggcagaaggaactatcttatgaaattaaaactgaagaaattcatacagatcttgtcgccagcacagctgattgcattatattattttcttgctgtgacggtggcatttattttgctaagtctgccggccgcccacaaacaaggggccagctggtcgtttatagacgcgctgtttacggctgtcagctcagtcagtgtcaccggtttaacggtcgtcaacacggctgatacattcagcacggccgggattgtcattttggctttcgtgcttcaattcggcggaatcggcatcatgacgctcggaacattcgtctggctcattatgggcaaacggatcggtctgcgggaacggaagctcatcatggtggatcagaatcaatcgcagttttccggtatcgtcaacctgatgaagcaagtgctgtttttgattttattaatcgagtttttaggcggcatcatcttaggaacatattttttaacgtattatgattcgtttgaacaggcgtatttgcacggattctttgcgagcgtcagcgccacgacaaacggcggttttgatattacgggtaattcactcgtcccgttcagacatgactatttcgtgcagtttattacgatgcttctgattattttcggtgcgatcggttttccggtgctcgttgaagtaaaggactttttgttttcaaaacagcgcagatactcattcacgctgtttacgaaaattacgaccgttacgttcggaatgctcgttttgttcggagccgtgggcatttacgcgcttgaagcaagccatgttatgaaggggaaaagctggcatgatgttttatttttatgtctctttcaatcaactgctacgcgaagcggcgggcttgcgacaattgatatcagccagctgtcggcgccgacattatttttcatctgtgccctcatgtttatcggtgcatcaccgagctcggtcggcggcggaatccgtacgacgacgtttgcgcttaaccttcttgctctgtttcattttgcccgggggaataaagcggtcaaggtctttaaacgcgagcttcaccaggctgatgtcatgaagtcgcttgtcgttacgatgatggcgattctgctcgtgttcggatcgacgctgattctggccgtgacggagaaaaatcagacgctgctcggactgctttttgaagtgtgttccgctttcggaacgaccggcctgtcgctcgggattactccgcatttaagcgacatcggaaaatgcgtgatcatgattgtcatgtttatcggccggatcggcattttgacgttcctttatttgatcggccgaaaagaaatcgaagcaaattatcactatccgaaggaaagaatgattatcggctgacaccgtttttcagaaagcggtgttttttattgccgtaaaatggatgagtggaaacagtttctttggagattctacttgtaaagaggtgacgtcattgtttgccgtattttggaagtcggtagttatgatagcggtcggtacctttttattgcggattgccggacggaaatcaatcagccagctgtcggtgacccagacagtcatcatgatttcgatcggctcgattattattcagccgtttattgaacataatttatgggaaactattttcgcggcggcgatttttattgcggtgttaatcctgatggaatatttagaaatcaaatcaagcttttttgagtttttattttcaggaaaaaccgtcgccgttgtcagaaacggaaaaatcatcccggaaaacttaaaaaaaatgcgttttaccgaagatcagctgtcaatgaggatcaggcaggaaggcctcggagacattcaagattttaaatatgtgctgcttgagccgaacggacagatcggctatgaactcattgatgaggccaaaaacgtgacagtgcgcgacttgaaaaaaatgcttgatgaattcaaaatagatttgctgacagaaggaggaaatcaaatgaaacgcaaagcagcaaagaatgaagctttaaccaacaacaacacaccgactgagagcatggacaaagatgcatacaaaacacaatatgacggtgatcccggactgagaggcgcaaaccgcaaatcaaaacacggcaaacaaggaggcgagtaacatgacgaaaaaaaaccgccacagcaaagacatgcaaaaccataaaaagccgatggaccctaaattgcttgaagaagagtttgcaagcgagctcggtgattataacgccggaaaatggattgaaacgcttgaacagacgaagccaaagaaaaaagaagacggcaaaaaataaaaaatacctcttaggcggcaacgcttaagaggtattttgcattatttcgaataagcaccgtttcttgttcctttcaccgcttcaagcaagccggttatccgcagctcaataaacggctgtgcggccgttttcaccgcattgctggagagaatggacgtaagagcggccgttaacattaagagcatgactaaattctgataatcagacaagtgatcttcaagcccgatctgccgcagcgtttttataatgaatccatgcagcagatacacgtaaaacgttctcgtaccccatttcgtaaagaaataacgcttttgcggaacgagcgccaaaaagctgaaagtggcggcaaaggccaaaacataccagccgatgcgtgacagaccgctcaacagcgacactgtgccgaatgtggaataaggctccgatccgaacagccacgagtaatcaaagtcaatgcaccagcataacaggaaaacaatccccagcacgcccgcggcaatctgcctgcctcttttagcccgaagcaaatcaaagtgctgtttctttaaataaaacccgacgagaaacatcggaagaaaaacaaacgtccgtgaaagactcagcgtgctgctgataaaatcaagatacccgatcatgacggcaagcccgcagctcgccccaagcgcccacattttcggcagcttcgtaaagggataaagcagcagattccaaaagaataagctgactaaaaaccagagagaccactgcggatcaatcggattgacgcttgccatgctttcatcctgaatcaaatagtaaaaaactgagtaaatgccctggaaaatcaggtacggaataatcagcttcacagccagcttcttcacataacctgtccgcttaaagttttttgcgaaatagccggaaaccaggataaaggccggcatatgaaaagtataaatgaatttgtagagatggagcataaactcatttccgttaataaatgaccggaggatatggccgaacaccaccagaaaaatcaagataaacttggcgttgtcaaagtaactgtctcgcgattttgtcatagcatcaccttctcttcaaaaatcatccactgcatgattatttcctgttggtgttcattttaaaataaaaaacaaaaaattgaaggaggacaaaagggattgttaggatgatgtaacggggaggtaaggatcgtagaaaaagactttaacttgtcatatcattgaaattttctgaaatgtatagggcgaatgaaggaagatgaggtattttgtagaaatattgaaggataggtttttgaagaaggagtgtactgaatggctgaaactctggatttgcaaacaaacgagtcgctgaaagagcagctgaagcggatgaaagaggaaaatgaccgcctgaagagtgatttgaaccggtatcacgtgattatgaataacacgcttgatgccatttttatatgccgtaaggaaatgaaaatcgtccaggcgaacgaggctgcggcccggatgatgcagattgaggcagagaacctcattaaccgctccgtcctggattttttatattccgtgcctcaggaagaactgaataaggccgtgaaaaagtttttaaaaaaaggccatctgtggaaagaggtgccgattaagcttgacagcggcgcgacgaaatacattgaattcctcgccagagacggaattggggaggattatttttttgtggtgatgagggatatctcctctaaaaaaatattagagcgcgaattctccatgaacgagcagctgtttaaagatttgtttgacagggctgtcgacggcatcgtgctgtttgataaggacggcgggtttattgatgcgaacctctctttttgcaaaagctttgagatcggccagaatgaattgtcccatctgtcgctccgccattttaccgacggagaaaacaaaaagcatctgaaagaaatctgggaaaccctccgcagaaaaggaaacgccaaaggagaactgcccgtcaagcttcggtccggcgaagagaagctgtttgaatttacgattacgtccaacttaatcagcgggttctacatgtccattatgagagacataacagagaaacggctgatggaattgaaactctttaaaagcgaagagcgattccgcgaaatttttgaaaacgccatggacgcgattgtcatttggtctgatgacggaaagattgccaaagcaaacgaatcggcgtgccgcattttcgaactgccgatggataagctggtggagacgaatttatgtacgtttatcgttgatccgcagaaaaaatacaagcagattaagaagaaatatgaaaaatacggggaaatccgtgaagaaatgctgtttcagatggcaaacggccaatttaaagagctggaattcacatcaaaacgaaccatacttgaaggtcagcatttaaccattttaagaaatgtcagcgatcgtaagcggatggaaaaagaattgcgggaaagcgagctgaaattcagaaaagtattcaacggctcaatggacggcaaggtcttatttgacaaccaattccgcattattgacgcgaatcctctcgcaagccgtatacttggtatgccggatgaggagctgagagcgtacaccgttccggatattctttctttatttgatattgaaaacgcgggtgttcccgccagaaagattgatttagaaggaatggataatgaaatccccttcctgttaagcagcagcgacagccgcaaactggaattctccttcaaaagaaatatcattcaaaatatgaatctggccatctttaaagatgtcacagaggccaaagagcttgaagagaggctgcggaaatccgatactcttcatgttgtaggggagctggcggcgggcatcgcccacgaaatcagaaacccgatgacggcgctgaaagggttcattcagcttcttcaaggaagcattgaaggcgaatattctctgtactttaacgtcattacctcagaattaaaacgcatcgagtctatcatcactgaatttttaattttagcgaaaccccaggcgatattatatgaagaaaaagacgtgacgcagattatgaaagacacggctgatcttttgaatgcccaggccaatcttgtcaatgtgcagatccatctgaacctgaccggaaacatcccgccgatttactgtgaaccgaatcaattaaaacaggtgtttatcaatattttaaaaaacgccattgaagtcatgccgggcggcggcaatatctacgtgaccattcagtcttctgatcaagaccacattttgatttctattcaagatgaaggaacaggcatttccgaagacaaattaaaacgtctgggtgaaccattttacacgacaaaagacaggggaacgggcctcggcctcatggtcagttataaaatcatcgaagagcatcagggccgcattcatgtggaaagtgaagaagggaagggcaccgtttttcatttgacgcttccgatccggcagaatacggaagaaagaaggagcggggaatgatctgttttacaagtgtaagagcgccgtttggaaccgtcatcgtaacagaggaagagagctttattaccggcctgtttctcaccggggaagattttgaggaatggcggaaagacgcgcccggcgtaaagccgtgcgaaaccgctttgctgtcggaggcgaaacagcagctggcatcatatttttcaggagaaagaaagcaattctctctgcctctgagacaaaaaggcacaccctttcaggaaagggtgtggaacgcgctgacgatgattccttacggggaatcccgaagctacggcgatatggctgaagcgatcggaaaaccgaaagcggtgcgcgccatcggacaagccaataaacgaaaccggctgccgattttgatcccgtgccatcgggtaatcggcaaaaacagcgccttaacgggatacgcgggcacgaagacggatgtaaaagcggtgctgctgaacatcgaacaaatatcctataaagaaaaataaagcgtatggcacgttccgttttttcgcgtccgacatatcattttattaagtgaaaaaagttgccctgatgaaaaaggaggacgaagcctgatgaaaatgagccgtccgcaaaagatagccggttatgcagagctgttttttaaaatgcatctcattacagccgcccaaaaagatgaagtgattacattgtgcagacaaaaaaaccgctgacattgcctgaggcaatatcatcagcggtttttcagctcagctggcagtcagcgaataattgttcaatttcttccgtgtaagaaccggtcacaattcctttctcggttattatgccagaaatcaggctgcccggtgtgatgtcaaaggccggattgaagaccggaacatcctcgggagcggtgcgtatgccggagatctgtctgacttcatccggatctctttcttcaatcggaatctgatcgccgttttcaatctgcaagtcaaatgtcgaaagcggtgcggccacaaaaaacggaatttgaaaggcgtttgccaaaatagcgaggccgtacgttccgattttgttggccgtatcaccgttttttgcaattctgtcagcgccgacaatgaccgcagaaatatgtttttccttcattgtatgggcggccatgctgtccgtaatgagcgtgacatcaattccgccctgcatcagctcccacgccgtcagccgtgatccttgaagaacgggtcttgtttcacatgcgtagatatgaaggccgaggtctttttgtttcgctaagtaaaagggggcaagcgccgtaccgtaccggcttgtggcaatcgagcccgcattgcagatggtcatgatctgatcgcctttattaaaaaggtgcagagcattttggccgatcattcggcatgtttcttcatcctcaatctgaatttgaatggcttcatgaacgagcgttgtcttcgcttcattgattgagatcgcatccctgatcgaatccgtaagtctgtcaagcgcccacgcaaggttgacggcagtgggcctcgaactgtttaaatacgctttgacatccgcgaattgacgtcggaaatctgaaaggtcgcgggcttcaaatgacttggcggagagtgcgagtccgaacgctgcggttataccgatggccggggcgccccttactttcagcgtgacaatcgcgtcgaatacatcttcctttgtttcaagttccgcatattcagtgacgtcgggaagcttttgctgatttaaaatgcggatgtaggtttctttccattccacagaacgggggatggcaaattcattggtcatgctgcatcattcctttacacggagcttaaattggtccagaacctcggtgatatgcttcagtttttttctgttttcgatataataggcgccgatgtcaagcgccagcttcttccgttcgattcgtttgtcaaacggagtgatttcatctaagtcagccacatgggcgagtccgatcgtgcgccggatcaattcgcatcccgcaaaaccgaccgcttcctcaaacgcgtttttcagtgtgtcttccagcaggtgtctgcgggaaggcaagcagtctttctcccatgcttcactgaatgttttcacaaatgtatcccatacggcagcggtgtggtcatataacggctgtctgtcgtcaccgtcgcggctgagggcgtttaacagcagattggcgataaattggccgatgtcaaacccgatcggtccgaagaaagcaaactcgggatcaatcacctttgtttcatgttcatctgcgaagatgcttcccgtgtgcagatcgccgtgaaccaatgtttccgcggaattcagaaagatggctttcaattcgtcagcgccttctttcagccgggaattgttccaaactttttctgcgtatgggcgcagctcctcttcaaaatcgtttgtctcatggtcgagaaacggttctgtaaacacaagcctttctgtaatattgcaaagctcaggatttgtaaactgctttgcgagctgctgctttactttcgcatcaagcgcgtaatcggatgagtaaaaaagcgttttccctaaaaattcaccgatatgaaccgataagttcggataatgctgcccttccagcagcccttttcttgaaatccgcaaacgggagaggtcttccattaccgtgacggccatttcagtatcggaatagtaaacggccggaacgaggtgcggcacgtgttcgccctggcggatgagggcgctgctttcgattctcgcccggtcaatggtaagcggccagctttcaccgacgactttcgcgtaagggattgcctgtttaataatcagtccttttttgttttctttatcgtaaacatgaaagacgtaatttaaattgccgtcgccgatttcacggcatgtcagagtgcttttgctttggaataagccgagcttgacggctaacgcggcggcggagctttctgttaattgttcataaagacttgttttagttgctgacatggatttaccctccaattatgtagtggcagtaagagatcgtgacggagaatacgcccgaaaaaaagcccccttctctgaaagagaaggaggctgaaacagtgcagtccgcctcttatctctcagataacatctgatggaattagcaccgtgccttatgagacaatcgtctcggcgcaaaatgtacgcgccccatttcacaatggaattacggtcggttgctgttggggtcaaaaggccaatccctcgcccaactctcgataagagaaaaatatattgatttgtatcacaattcggattaatcagttgatgaaaatattagcaggtgccggatattcttgtcaacgtttttttgaaaattaatataaatcacgccgcaagtcttggaaaaccggaatggttccgcggacggccgcgctttctgacacatcgatttccgtccggactgcgccttccgtccggtctccttcggctaaaatccggccccacgggtcaataatcaggctgtggccggcaaattcattatcgggattggaccccgtgcagttagaggctgcgacaaaacattggttttcaattgctctggcgataagcaggcttcgccaatgatcaaggcggggcagaggccattcagcagagataaacaggacattcgcgccctgggacgtatgctttctgatccattcggggaaacggatatcatagcagatcagcccggcgcacttgacaccgtcaagctcaaaggaaccgtcactatttcctgctgacaagtaaaggtgttcatccatcagctgaaacagatgtgctttctgataccgcttcacgatctgtccgctgttatcggcgatgtacatggtgttatagacattttcgccttctttgaccgcaaaagatccggcaacgaggtgtacgttgtatgtttttgccgtttctttaagccattgttccgaaactttgccgttttcatccgccagctgatctagccgtgtgagatcatagccggtcgtccacaactcaggaagcacgattacatccgcatggcggctttcttgctcaatcaaagattctgcttttttaaagttttctgaaggatttccgtatgaaatatcaaattgcaaacaggaaacggtccatttcattttttaacacctcaagtttctctttactttttttatttaaccatatatgatgatggactatcatttcaagacatttttagaaggtgaaaatatgaactttgaaatctcagatgtactcaaacagctgccggaacaatttttcgcatcattggtgcaaaaagtgaatcaaaagctgaaagaaggcagagacgtcatcaatttagggcagggaaaccctgatcagccgacgcctcagcatattgttgaagaaatgaagcgcgccgtcgaaaggccggaaaatcataaatactcatcattccggggcgcttacagcttcaaaaaagcagccgctgcattttatgaaagggagtacggggtcacgcttgatccggaaacggaagtcgccgtgctgttcggaggcaaggcgggacttgttgagcttccgcaatgtcttttaaaccctggagataccattctggtgcctgatcccggatatcctgattactggtcgggcgtcgcccttgcaaaagcgaaaatggaaatgatgccgctgacggaagaaagagggtttctccctgattacagcgtaattcctgaaaaggtgcggagcgaggcgaagctgctgtatctcaattatccgaataatccgaccggcgctgtggcgacagaggcgtttttcgaggagacggtcggttttgcggagcaaaacggcatttgtgtcgttcatgatttcgcgtacggagccgtcggctttgacgggcataaaccgctgagctttttgcagaccgaaggcgcaaaagagacgggaatcgaaatctataccttgtccaaaacctataatatggcgggttggcgggtcggatttgccgtcggaaacgcttctgtcatcgaagcgatcaacctttatcaggatcatatgtttgtcagtttgtttcccgcggcgcagcaggcggcggcagccgctcttttagcggatcaggcatgcgtcgcagcgcaaaatgacagatatgaatcgagacgcaatgcatggattgaagcctgccgcgatatcggctgggatgtgacggctccggcgggctccttttttgcatggctccctgtgcctgacggttatacgtcacagtcgttttcagacctgctgctcgagaaagcggatgtcgcggtcgctgccggaaacgggttcggaaaatggggggaaggctatataagagtcggtcttctgacaagtgaagaaagacttaaagaagctgcggaacggatcgggaaactgaatcttttcacccgaaaaagcattgacatatcaggataacaatgcgataattcaaaatactttataaaatcattattcttatcaagagcaggcagagggacgagcccgatgaagcccggcaaccgactgataaagcacggtgctaattcttgcagcaggagctgagagataagattcggacataacacgaagcctctttctgctcatacggaagaggtttttttatgttttgcgaaagaaagagaggcgttcacgcatgagcgaagtattggcaacatatcttctgacagacacaacggacagtgaaaagcgggcggaacagattgcggcggggctgacggtaggctcctggactgacctgcccctggtgaagcaggaacagctcagaaaacataaagggcgggtcgtaaaagttgaggagaaagaaggaacctcagaaaacgaaacacaatccgtcatcaccatcgcctatcccgaggcgaacttttcaagagatattccggccgtcctgacgacggtattcggaaagctgtcactggacggaaaaataaaattgactgatcttgaattttccgaagggtttaaacgctcccttcccgggccgaaattcggtatatacggcatccgcaaactgctgggcgaatttgaaagaccgcttctgatgagcatatttaaaggcgtgatcggacgggatctcgccgacattaaagaacagctcagacagcaggcgctcggcggcgtggatcttattaaagatgacgaaattttctttgaaaatgaactggctccgtttgaaacccgcattatcgaaggaaaacaagtcctgaaggaaacccgggaggagacggggcataaaacgctgtatgccgtaaaccttacgggaaggaccgctgaattgcgggataaagcgaggcgcgcggcagaactcggggcggacgcgcttttattgaatgtgttcgcttacggtttagatgtgatgcagagccttgctgaagacagggaaatcccgcttccgatcatggcgcatccggcagtcagcggcgcgttcacatcatctcccgtttacggcttgtcgcatgcgcttttgctcggcaagctgaaccgctattgcggcgctgatttcagcttatttccgtcaccttacggatccgttgctcttccgaaggagtccgcgcttgcaatccatgatgaatgtgtaaaagacgatgtctttcatccgtcgtttgccgtcccgtcagcaggcattcaccccggtatggtgccattattgatgcgcgatttcggcatcgatcacatcatcaatgccggcggaggcattcacggccacccgaaaggagccgagggcggcggaaaagcgttccgcgccgtcattgatgcggtgcttgaagcgcagccgattgaagaaaaagccgcgtcgtgcaaagatcttcagctcgcattagacaaatggggaagggtggaagccgtatgacccgcacaccgctgattatttgtgatttcgacggaacggtcaccatgaacgacaacattgtcagcatgatgaaagaattcgcgcctcctgagtggcttgaattaaaagacggtgttctgtcaaaaagcatatcaatccaagaaggagtcggccggatgttcggactgctgccgagcagcttaaaagaagaactgaccggctttatcctgaaggatgcgaaaatacgggacggctttttggatgttgtctcgtttgtccgctcaaacgatctcccgttttatatcgtaagcgggggaatggacttttttgtgcatccgcttttggaagggatcgtagaaaaggagcggattttctgcaatcatgcatcctttgacaatgaatatattcatatagactggccgcacgcctgtgacggagactgtaccaatcaatgcggctgctgcaaaccgtcagtcatccggaagctatccgatcagcagaaatttctcgttatgatcggtgattcggtcacggatgtcgaggctgcaaagttatccgatatgtgttttgcgagagattatcttttgactgaatgcaaagaactcggcctccggcatctgccttttcaagattttcatgaggtgaaaacaggcattgaaaacatcggggaggtgcaggcatggctgcaaaagaagaacgctggcgcgaacttgccgaggtaaaacgcgagctggccgaaagagactggttcccggcaacgagcgggaatctttccatcaaagtatctgacgggccgctgacttttctcgttacggcgagcggaaaagacaaacgaaaagaaacagacgaagattttctcttgatcgatgagaacgggaagcccgctgagaccggccattctttaaaaccctcagcggaaacgcttctccatacttacttataccaaaagacagacgcaggctgctgtctgcatgtccataccgtcaataataatgtcatctcagaactttacggggatgaaaaacaaatcacttttcaggggcaggagatgattaaggcgctcggattatgggaggaaaacgcgtccgtgaccgttccgatcattgacaacccggcgcacatcccggcattggccgaaagcttcgcgcaccatgcggacgccggctcaggcgcggtgttaatccgcaatcacggcattacggcatgggggcggaccgcatttgaagcgaaaagggtgctggaagcctatgaatttttattcagctgtcacctcaagcttctgtcactgcggccgcagcttgtaaaataaaaggaggaatagaaaatggcgaccatcagaattcatgacgaaaagaatacgctcattgaaaaacaggaagaagtagcgcgcttcttagacgaacaagaggtgatctatgagcagtggaacattgaaaaacttccgtctgagctttcggagaaatacaatctgacagaagatgaaaaagaaaggattctcgcggcgtttgacaaggagattcaggatatttcagcccggcgcggatatcagtctcaggatgtcatttctttatcagataccacgccgaatcttgatgaattattaaaaaatttccaaagagaacatcaccacacggatgatgaagtccgctttatcgtcagcggacacggcatcttcgtcattcaaggcaaagacggcacatttttcgatgtccgtttaaatccgggagatttgatttcagttccggagaacatccgccactactttacgcttcaggaagaccgccgggtcgtcgcaatccgaattttcgtgacgactgagggctgggtgccgatttacgaaaatgaaagtgtgcaaaactgatagacgcccgaacctctcatgccccgccggcatgagaggttttttattgtaatataaagtcagctgtggctgttttttaaatcttgaatatgccgcattctgtttatatcattacctgaatgggtattattctcgtattcatgctaaagattccaatatgaaatgaaaaaataagttatttagtaaaaaaatgtttacaaataaagtataatctgtaataatgctcaataacccaatcaaacttgtttcctattcttttagcggtgaggggtgaagtgaatgggcagttattctgaacaagaaaaattgcttgtatctattgataaaaaaagaaaaatgatgatagatgcggctaacaggcaagggtttacaggatatgacacgatcaggcacagccaggaactggactgtctgatgaacgcgtatcagcagctggtaaaccgtgatcgtacacatcaccaaggaatacagggccttgtgaagaaaataggcttgttctcccgcggtgacgtcatgcctgcatatgaagcaaacaaatgattgatgataaaacagataacgaagactgaatgcgcttcctgatcaagcgccgcatccgaaagatgaccgcgtacagtcagcagatttttccgctggcacggctcacgaagcgcctcgtactatctgccggctatgatgccgttcctctggtatatcctcttacacatattcttctttaaataaaaaacaccccgatccagggtgtttttttcatcgtgaagcggcagggagggcaatggtgacctctgtccccttatcgacttcgctttgaatgtcaatcgaaccgccgtacatcagcatgattcgtttacatacgacaaggccgaggccggtgcctttttcctttgacgtgacaaacggaagaaaaatgtgttcaagcatatcttcagaaatgcccattccgttgtcggccaccttaatgactgctttatggtcgcgggcttctaaatagatggacagccggccgccttcctgcatggattccagcgcgtttttcgcgacatttaaaatcacctgtttaatatggtctttcgtacagttgaccttgagcggccgattgacgagaatctccacattcacttccacattatacagattcccttcagaataaataatcggcataatttcatcaagaatatcctgcagcgagttcacttccaaccgttcagcagtaggtttaccgagcactaaaaactcactgacaatctgattgatccgtttaatctcctgctcaataattgagaaatacagctgatcttcctccgatttgtattttttctgcaaaagctgaatgaagccgctgatccctgtaagcgggttgcggatttcatgggcggtgctggcggcaagcgttccgatcagctccaatttctgcgcttcattttgagcgcgctccagctgggtcttgcgcttaagcagataatattgaacgaggatgaacagaatattcagcagcacggcaatactggacatcggcagcagcacgcttttggtcagctcgttcagctcaaccggtttcggataaacattgatattccaattaatatcatccagatagccgctgaccggttgcaccccttctgattgatcagcccgtccgctggcaaatatcactttattctgattggttgccttgacataaacgtcagggctcagcatattgatcatatttctcaaataatcgacttgaatggcggctactaaataatccgtgacttcccgttttgcgtctaacaccggcacgcagatcgtgaagatgcgctggcctgtaattctgctggagtagtcatttgtgataaccgtttttttcgtctttttcgccttcgtaaaatacggtcggtcggccaaattcacctttgatttcagatcagtcgtgcttgcgatgacatcacctttggaattcagcatatacagaccgctgaatctgggttcatcctcaaaagcctgatcgagaatatcaatgatcttttcttcattgacaggcttatcgacagcgatcgcaagtgttgtcatccgggcttttgtttcaccgattaaataattgagcttattgcggtgaaggttgagcatcatactggcttcctgtatgtgtttatcggctattttctgcttttctttttcattaatgaaaaagctgataataagtgccgggatgatcaccaatatgagataaagtttgatctttccccgggcacctttaaatgtattcactctgcatcgctccaacattacacttgaatagaggtattatatcatttttatacttctttaataagaaaaaataaccaaaatgatagaaaaacaaattattttattaaggccagacaaaaagaagagaaattttggaaacatttttgttgacatttttcattttgtttattaatgtttctctgtaacggtttcttttgtaaaaggatgattgaatgtatgacggataaaacagaaaactcattgaaattatttattgtactgtcacgtgcgtaccgatctattaacgaccatatgaataaacatattcataagcacggcctgaacccgacggaatttgcggtgcttgagctgctgtaccacaaaggcaaccagccgcttcagcagatcggcgacaaaattttattagcgagcggaagtattacatacgttgttgacaaattagagaaaaaagaacttctcatcagaaaagcttcgccgactgacagaagagtgactttcgcacagatttccgaaaagggaatccgtcttttggacgatattttccctgatcatgctgaagaaattaaagaaatgatcagtgtgctgagtgataaagagatagaaatgtgtacggaaatgctgaaaagagtgggattaaacgctaaacattttcatcagaaataaaaaaggaagccatttgaaaggcttccttttttatattactgattttggtcagtcgcggcgtttctaggctgtatcaatacctcgacgcgcctgtttttgctgcgcccttcagcggttttgttcgacacggccggtttatactctccgaaacctttggcgctgaaaacttttgcgtcaagtttcgggttttctgtcagaatagccatgaagttgacggcccgcatgacgcttaaatgccagttagattgatattgtgagtttttaatcggtacattgtccgtatgtccgctgatgataatgttcctcggcggattcagcacaaggagattcgagatttccttggcaagcggaatatcttcctgacggatatccgcccgtccggaatcaaaaaagatactgtctttaatcgtaattaagagtccttctttagtcagctttgtttcaagctgagtttcaagctttttattttttataaattgattgacttgcttttgcacgccttcaagttcttcgcggtcggctgcttctctttctttctttttctgttctttatctttttccttgtctttttttaactgatcaacgccgtctttttcgttttcaggaggggtgaggcttgaatattcaagaacacccgtgcctccggtaaacacggcgttaaatgatttagacagcatttggaatttcgccgcatcgaccgagctcatggcgaacaatacaatgaacagagccaaaagaagggtgagcaaatccgcgtacgggatcagccaagactcatccacatgctcgtcatcatgcttcttcttcttttttctcgccattgtttgcctctccttcttgttcagcgacttttgcgcgttcattcgcaggaagatacatgagaagtttttgttcgatcactttcggagcctgtccttcaagcactgacagaacgccttcgatcatgatttcacgcagtttgacttcctgctttgatttgcgtttcagtttgttggcgaagggatgccatagtacatatcctgtgaaaatcccgagaagggtggcgacaaacgccgcactgatggcatgtccgagcgcctcggtgttgttcatgttggaaagagcggcgataaggccgatgaccgcacccaaaacgccgagtgtcggcgcatatgtgccggcttgtgtaaagatggctgcgccggcctggtgtctgtcttccatcgcttcaacttcctcagtcataatatctctgataaattctgcgctttgtccgtcaaccgccatgctcaggccgtttttcaaaaatgcgtcatccacgtcttcaatgcttgcttccaatgcgagcagaccttcacgtctggcgatttgcgcccattgagagaacataggaattaattgcgcaattgtcagctgtttgttttctttaaacagcactttaaaaagggcaggcacttttttgatttcttttccggggaatgcgatgatcaccgcagaaatcgtaccgaacaaaataatcagaatagctgccgggttagcgagtgcgcttaagctgacccctttcagcaccatgcccacgcttaaagcaatcaaggcgaggatgataccgataatcgatgttttatccatagttttcaccaaatcctttatactagctttctatggttaatatcggtggcagtgcatggaactttagggtgattgagaaattgttcccgaattcttcacagtttctcccttccggcatggagaaagaaacaaaaaagcggctccccgaaaggagggaaccgcttttttcttattgtgcccggactttgatgccgtcctcttccattacgacatggaaggcttttatttcgttgtcatccaataagagatctgtcatttcgtcctcgatcaattcttggatggttcttctgagcgggcgtgctccgaaagcggggtggtagccgatttcagcgattttttctttcgcatcatcggtgacgctcaggctgatgccgcgctcttttaatgtgtcttcaagctctgtgagaagcaggctgacgattttcacgagatgttcttttttcagggattggaattcaataatgctgtcaaatcggtttaaaaactccggtttgaagaacgcgctcagtgaatcaatcagcgtttgttcttccaggacgctctcttcagattggaatccgactttcacctgtttttcgccggttccagcgttgcttgtcataatcaaaacggtatctttgaagctgaccgttctgccctggctgtctgtcagacggccgtcctccataatctgcagaaacatatgctggacatcagggtgggctttttcaatctcatcgagcagcacgatgctgtacggattgcggcgcactttttccgttaattgaccggcttcatcgtgtccgacatatcccggcggtgaaccgatgatttttgatacggcgtgtttttccatgtattcactcatatcgagacggataatggaatcttttgtaccgaacagttcatctgcgagtgtctttgataactcggtttttccgactccggtcggtccgacaaagaggaaggagccgacaggtctgtttttggattttaagccggcgcggcttcgtctgaccgctttcgccacttttttcacggctttttcctgaccgatgacgcgctgatgaagatgctcttcaagttccttcatttttacttgttcatcagcctggagttttccgaccggaatgcctgttttctgttcaatgatggcttgaatatgctccgccccgatttcaggtgaagaggccggtgtttcatgcgccagctgtttttccaacgccgcttcttcatcacgcagtttcgcggcaagctcataattttcttcatgaagcgcttttgttttctccgcgtcaattgctttgagtctctcagccgcatcttcttcatttacggtatcaagctccaggttcgccttagagccggcttcatctaataagtcgatcgctttatccggcaggtggcggtcctgaatgtaacgggatgaaagcgtaacacaggcgtttatcgcttcattgctgaatgtgacgccgtggtatttctcatatttatctttaatgccttccagaatgctgatggcttgttctattgtaggctcgtgaaccatgacaggctggaagcgtctttcaagcgccgcatctttttcaatctggcggtactctttcagcgttgtcgccccgatgacctgcagctcgcctctggcaagcgccggtttcaggatgttcccggcatccattgatccctcggcagagccggcgcctacaagaagatgaatctcatcaatgaacaagatgacgtttttccgttcttttaattcgttcattaattgtttcattctttcttcaaactggcctctgatccctgtattggcgacgagagaagcgacgtcaagcaggtaaagctctttgtttttcaatttgttcggcacatcgccttcagcgattttaagcgcgaggccttctgcaatagccgttttaccgacgcccggctcaccgatcagcaccggattgtttttattccggcggttcaaaatttcaattacgcgcgccacttcattatcgcggccgatcacagggtcaatcagacctgcttttgcgccgtttgtgacgttttgagcgagctcgtcgagcaggcctttttcagggccggcctgctgtttattttgattgggagcgaaaccttgctcaaacgggaatccgaatgattgcggccccatgctcatagacggttttcgggttaattctgtataacatgtttcacataaaacgaattgtttttgaatggaattgacttgcatgttcaggcgaatcgtcgcctcgtttttctgacaatgttgacaacgcatttgccaaaacctccttgaaaaatgtttgatcatctttgaccaaatggattagaaaataaggccgaaactttgaccttctttgattaatagtatactctgaccttctttgactttcaagtattttgtttcaaaccccgaaaaataaatgtttacagcatgataagtgatatttgtgaggtttgattatttttgaccaatatagtcagaaaggaaatgaaatgctttgacctttcttgatgaagagtatacgccggccctttttttctttcaatatttttgcttagaggagagagctgaatctgttttctccggggaaggacgatttgttcgtcttttcgggcgacttgtctcataagcatatataaaggcctggacaaatctgcgcttagccggagggtgaaatgggacaaacaaaaggttctgcaagtcagcttgcatttgtatacgtaggcacggttgtaggagccggttttgccacgggacgggaaatcgttgagttttttctgaagttcggctggatcggtctgttcggtatcgtggtaagcggtctgatgtttacatatttaggcgccaaaatcatgatcatttccaaacggattcacgcagcatcttatcaggaattgaacacatatttattcggccagtccatcggccgtgccgtaaacatgtttatgatgtttatattgctgggagtgacctctgtcatgctgtccggagcgggggcgctgtttcatgaacagcttggatggtccgcacaagcggggatccttttgacgatcgtactgagctttgccgtcatgacaagcggcgttaaaggtgtgttcggcgtcaatatattggttgtgccgcttttaatttctttctcttttatcgtgacagctgattcatttgtatttacaagcacgagaaacgcggacgaatgggtatggcctgacaagtggaattggcttttgtccgccgtctcttacggcgcgttaaatttatcgctcgcccaagccgtccttgtgccgcttgcgaacgaaatgtcttcagagaaggtgatcagaaagggggcttatttaggcggtgttcttttgacactggtgcttgccgcgagctttttatcattatcggtgctgccggatgtgctggagtttgacattccgatggctcaagttgtctattcgtattcgcgttcgcttcatatcatttatttgtttattattttcggggaagtgtttacgtcagtcatcggcaatctatacggattggaaaaacaattaaacagttttcttcatataaaaagtacatatatttacggcggcattttggcgtttgctttcattatcagccaaatcggctacggacagctgatttccaccgtttacccggtgtttggatatgtgagcctcgcttttatcggcgcattgatttgcaaaaaaatcccgaaagaaaaataaggatataaggaaaatgtctgtattttttgggaattccccttcttttttcctgacatttctgtataatgaattgggaaatgatggggaggagtaagagatgaaagctcgacgtgtattattgggatttatttttatttgtatcggcattgcgttttatttacagaaggcgggagttatacatatatccgcaggttcggcgtggccgtttcttttcattataatgtccgcagggtttcacgccggatttatttttgcgaaaaaaacgcctgaccaggcgggactgctcgtaccgggcggtatgtttcttgtgctgggctgcctgtattgttttgaaacggcaacaggatggacgtattcaggcgtgacgtggcctgtttatatatgggcgcctgctctcggtctgtttgagctgtggtatttcggcgggaggaagttaggtgtattgattcctgctttcatcctgactgccgtgggagcactatgctttgccggtatgctgatgccggggctgtggccgcttttgatcatcgcagccgcgcttttgtttcacgccgctgcctttatgcagccgaaaaaaagatcgggccttcttattccgggcggcattttgcttgtgacgggcggcttgttatggtttgaaacgctgacggattggagatacgcaagtatgacatcgcctgtctacctctttgccgttgcgttcggcctgtttgaagcttggctgttcggcagaaggaaaagggggcttttgactgctgctgcggttctgtgcgccgcgggcattttcggcatattcaccaatgcaaatgaagtcatcagcgaacgaggctggcccgctctcattcttttgctgggcgccgcttttcacattccgattttcggcccgaaacctgtcaaaaacgcgggacttctcgtaccgggcggcatcttgttgattacggggatcttgtttgtctttgaaacggcaaccaattggtcctactccggtgtgacatggcctgtttacctgttggcaacggcattcggtttatttgagctgtggctgttcggcgggaaacagaaggcgctgctcatcccggttgcggtgctgaccttgacagcactttgctttatgatgacgtatcagccgatcattccggtttctgttttctggcctgctttatttgttctgatcgggattgcgctgatggtatttccggggaaaaaacgcggggcttaaatccgcttttgcagcctgacacaggtttcaggctgtttttttattgtcacgggaaacaatattatggtatgatagcaaaagtgaaaaaagaagaaaatccgtattgatgcgggagaggttctagctacaccctctataaaaaactaaggacgagctgtatccttggatacggtttttttatgttttttagggcgccttctccgaaaaaggcgctttttttatggaatgatagataagggagagaaagacatgaaaaaagaaaaagcggttgtggtgttcagcggaggccaagacagcacgacttgtttattatgggctttgcaaaactttgaagaagtggaaactgttacattccattataatcagcgtcaccaagaagaaatcgatgtggcaaaatcgattgccgaaaagctcggtgtcaaaaaccacttgcttgatatgtctcttttaaatcagcttgcgccgaatgcgctgacaagagatgatatcgaaattgaagcgaaggacggggaattgccgacaacctttgtaccgggacgcaaccttgtatttttatcctttgcatcgattcttgcatatcaaatcggtgcgcgccacattattaccggtgtttgcgagactgatttcagcggctacccggactgccgtgacgagtttgtcaaatcctgcaatgtcaccgtcaatttggcgatggaaaagccgttcgtcattcatacgccgcttatgtggctgaacaaagcagaaacgtggaaacttgcggatgagctcggcgcgcttgattttgtaaagaataatacactgacttgctataacggcatcattgcggacggatgcggcgaatgcccggcatgcctgctccgcaataaaggatatgatgaatatatgaaaatgaaaggagagcggaactaattgctttctcaaatttacccgcaggttcagcatccttattcgtttgagttaaataaggacatgcacatttcagccgcgcactttattccccgcgaaagcgcaggagcgtgcagcagagtccacgggcacacgtatacagtaaatattaccgttgcgggggatgaactggacgattcaggctttctcgtgaatttcagcgtgctgaagaaattggtgcacggcgcttatgaccatacattgctgaatgaccatgaggaattttctgatgatgacagatattcactgccgacgaccgaggtcgtggccaaaacgatttatgataaggtgcagtcctacctcgaaacactggagaaccagccggtctgcgtgcaggtttttgtcagggaaaccccgacaagctattgcgtataccgcccgaaaaaaggtgataggaatggctaaaggaattccggtattagaaattttcggaccgacgatacaaggggagggcatggttatcggccagaaaaccatgttcgtccgcacggcgggctgcgactactcctgcagctggtgcgactccgcttttacatgggacggctcagccaaaaaagatatccgctggatgacagcggaagacatttaccgcgagctgagagaaatcggcggagacgccttttctcatgtcaccatctcaggaggaaacccggcgctgttaaagcagcttgacgcgctgattttgctgctgaaagagcacggggtgcgcgccgctttagaaacgcagggaacggtctatcaggattggttcacaatgattaacgacctgacgatttcaccgaagccgccaagttcggggatgacaaccgattttgcaaagctcgatcacattgtgtcttcgcttgatgcggcagaaaggcttaacgcggtcagcttaaaggttgtcatttttaatgatgaagatctgcaatttgcgaaaaccgtgcacaagcggtatccgaatattccattttaccttcaggtcggaaacgataacgtccatacgacagatgatcagtcactgattgcacatttgcttgggaaatatgaagcgcttgttgataaggtagctgtcgatgcggagctgaatctcgtcagagtgctcccgcagctgcacaccctgttatggggcaacaaacgcggagtataatagaaaggaagatgaacatgacgacaagaaaagaatcagaattagaaggtgtaacattactaggcaaccaaggtacaaattatttgttcgaatatgcaccggacgtgctggaatccttccctaataaacatgtaaaccgtgactactttgtaaaattcaattgtccggaattcacatctttatgtcctaaaacagggcagccggacttcgcaaccatctacatcagctatattccggatgaaaaaatggtggaaagcaaatcgctgaagctgtatcttttcagcttccgcaaccacggagatttccacgaggactgcatgaacatcatcatgaatgacttgatcgaattaatggatccgcgttatatcgaagtatggggcaaattcacgccaagaggcggaatctccattgacccgtatacaaactacggcagaccgggaacaaaatatgaaaaaatggccgaacatcggatgatgaatcatgatatgtatccggagacgattgacaaccgttaatttcagacggagtacggtctcggaatataacctaaatacccccgccttttaagcgggggtatttttcgtctctgccacgcagccaaaaaggtgcatgatattcgcacagaacttctataaggaaaagagagatcatttaaagaaaagaaaaagacgagtaaacccgggggagtgtactcgccgcttcattacgtgacgggtgctggatggcagctcgtctgtttcattataaaatagggaacgtatgtttgtaaagacctgcgctgttttttctcattcggagcggattaaattgtaaaggaatggtcagcatgatagcatgtcctgtaaaaagaaggagtgttcgttatggagccgttagagttaaacggtgtaaggctgaaaatgtatgattgtaaagaaagtgcgggcaaaaacggccgtatgatttcatttgtattgaaggtgacctctgaaacgtatcatgatattgccgtccttttgtatgaaaaaacatttgacatcaaggcgcccgagcgcgggcttgaattccgcggtaaaataaccaactactatacatccgtcacaaatctttacaataaagatgagaccggtgatttttatgtagaaatgaccgagatctgaattcatttgaaaaagctgccgggcggcagcttttgtgcgggatatgtaaatggttcggatgttcggggggtttaataggagtctctgatgattttataattcttatggttgacgacagtgagggaatctaattcaaggtcacgataattatccatgatggttacatcaacgatgacggagttttcatttactttttcaacaataccggttaatccgtttttaaattcaatgacgtttccaaccttagcaattttcacgagcttcctctcctttatcataaatcctgtttgaaaatattttgcagtattttctttaagaagtaaagcgatatgggtatcagcccgctcaatcattgtcccggcgggggaaagatggtatattgtttttcgggaaaaagccgagaaaaggaggctgtattcgttgctgcctgaggaaatttcagaacgtatcaaccaaatgcgcaccggtgaaatcaaagaattcagggtgcagaaagaacattttcttgcatttcgagcggttttgtcgaagcaggaagattttaagcatttccgcggtattgcccagcagggcggagatgttatatttcagtatttagaacagccaagaagctgacggctcctcgcacttgaggagtcttttttggggtttcagtttctcatttcatctggctgtaacagatgtaaacaaaatgtaaaatccctccgatggatacttttactgctatttggttaatgttgtgaaaatgacggctgttttcctgccaataacaaggctgttaacgaacttcttccatcataaaagctgattgggagcactggaaaatctttaaccgtgaatttgcgcacagctcttgttaaggtagtgaagtatttaaggaggaaatcgtatgacgacaaaatttgctgccttggctgtcttttttctatgttttatgcctgcatcaaaaattgaacatacagaagctctgtttacttttgcgaagaagccaaagcaagaacccagcacactggttgctgatttaaataaaaaaagctcggttccgaagctttcaaaaacggatcataagcattctatccaaccgataaagctgtcatctcaccaagagaagaaagcaaaaccggaagagacggcttatcagccgccgaaaaaaacgtattcccgcgctgacagacaacttctggcacgtctcgttcacgcagaagcgaaaggtgaatcttataaagggaaggttgcggtagccagcgtagtgctgaaccgcactgaaaaaaacggcttcccggataccattcggggtgtgatctatcaaaggaatgcatttgaaccggtagcaaacggaagcattaatcaaaagccggataaggattccgtcgccgccgcaaatgaggcgcttgatcatccgggcagagaaacgaacgcgttgtttttctacaatccgaaaacggcatctgaccactggatccgttcgcgaaaaattatcgagcggatcggcagacacgtatttgcgatgtaagcatagcgggatcaaaaatatcccggctatgcttttttcaattttgagaaatcgaaaatattttcagaacttgtctcatatgatgatggaagaacgagagacaaggagagacaccatgaatcgatttgtgaaagggatcattcttttatccatcgccgcctttttcgcggaatgtctggaatttgtcgtgaatatgatactggcgcgggagcttggcgagcatgggatggggctttacatgagcattctgcccaccatttttttaattatcgtgatcgcaagtctggagcttccgatctccatttcaaaattcatcgcggaatccaatcagaagctgcatgaaagcatgctccggcatgccttcagaatgaccgccgtttttaccgcgttttcaaccgcggccgcaagcatcgcgctgccgttcattcctgtattcgatacgtatcacccgtttattaaagggattgtcatcgggttgattccagtcgtcgcttttacatccatcgccagaggttattttatgggtgtgcagcaaatgggaaaaatcgcggttgcgaatgtcttgaaaaaaatcattcaagtgctttgtctgtttatcttttttcaatggtactcttttgaaattgatatggccgtgctcatttcattatttgtgctggtcgcaagcgatgttgtggtgttcgtttacttgtatacgcagtttattttggcgcggagggcgctttccggccatcagcacattcatcttcgcgggaaagacgtgcggaaacgcctcctggccgtatccatcccgacaacgggacttcgtatatttcatgcggtgacaaacgccattgaaccctttttagtgaaaggagcgctgctggcgtccggggcagccgggacagccgcgattgatcaatacggcatgcttgccggtgtagcgatgacaatcggttcgtttcctgcatttatcgcccattcgctgatggtcgtcatgattcccagcatttcagaagcgtatgcgctgtcccaatatgatattgtgctgaaacggctgagacaagcgatttttattacattcggctacggcattccggcagtctgggtcatgtttcagttcgcgggcccgctgacccatttgttttttcagtctccggaagcgcagtattatttgcagcttttgtggccgttttttctttttcacctgtttgtgatgccgcttcaggcctgtctgatcggcatcggccacgtgaaaacggcgttttatcataacgtatggagcagcattgtagggctttcgatgatgtatgtgctcggttctatgccggaattgcaaatgctcggcattatactcggcatgaataccggcatgattcttctgacaagtttacattacgcgacgatctgcaaagacctcggtgtctccgtgtttttgacgggcggcggaagaacagcgccccggatcgaaagctgaaaaggctgatacatttcaataaggaagggcaagctatccgaaacgcgtgaaaggaagatcatatgcataaaaaccacctaattgtatgtgcagtccttttgatagctgccgccgtctggatgcctgaagcaaacgcctcatcagaaaaacaggcagttcccgccgtgtttctgatgaagacgattgaaggagacgagatatcgattccgaataaagggcagaaaacgatattgcatttttggacatcgtggtgtccgccgtgcaaaaaagaactgccgcaattccaaacgtattatgaacagcatcagtccgatgatgtaagccttgtaacggtaaatctgatgaatgccgagcgaaacaaaaataccgttcaaaactttgtcagtcagcaccatctcactttcccgattgttcttgacacgaaaggcgagcttatgaaggaatacgatgtcatgacgattcccacgtcatttctgctgaatgaaaaaggagaaatcgaaaaaaagatcgtcggtccgatgaccgcctcacaattaaaagaatggtcagagaaataaaaaggtgcgggaggaattcttcccgcaccttttttgaatataatgaacagctgaagaaacactaatgataattattatcaaaaagaaattaaaacaattataattgaaatcttccgccggcatgctataataaagaaaacactgcgataacactgtgaaaatgctgcctgtcaggtggctgttttgcttttatcggggaattgaagatgatttgcgttctcaattagagaggagaattcataatgaatgaacaagtgatgacacaaacccattcacaacagcacatacaagaagagcgggccggaaaaaagtggctccagcatgcagaactcattgcggcgctcgtatccggcgtccttattcttgcggcctggttttttaccgaaacaaaaggcctgtccgtcactttgtatatccttgccttcctgatcgggggatttgcaaaagcgaaagagggaattgaggataccattgagacgaaggcgttaaatgtggaactgctgatgatttttgcggctgtcggctccgccctgatcggttattgggcggaaggcgctgttcttatttttattttttcgttaagcggcgcgctcgaaacatacacgatgaataaaagcagccgtgatttaacctctttgatgaaactggaaccggaagaagcgactctgcttgcggacggacgggaaaagcgggtgccggctgctgaacttaagatcggtgacatgatcgtcattaagccgggcgaacgcgtagcggcagacgggatcattgagtctggcgtgacgagcctcgatgaatcggcgcttacgggtgaagcgatgccggcggaaaaaacagccggagattctgtgtttacaggaacggtaaacggaaacggctccttaacggtccgtgtgacgaaaacaaatgaacagtctttattcagaaaaatcatccggctggtggaatcagcccaaaacagcgtgtcaccggctcaggcatttattgagcggttcgaaagtgtctatgtcaaaggcgtgctgttagccgtggctttgcttttattcgttcctcatttcgctttaggctggagctggagtgaaaccttttaccgggcgatggtgtttatggtggtcgcctccccgtgcgcgcttgtcgcttctattatgcccgctgcgctttcccttatctcaaatggggcccgcaacggattattggttaaaggaagtgtgtttttagagcagctgggaagcgtacggatgatcgcttttgacaaaaccggcacggtcactaagggacagccggcagtcgcggcatttcaagctgcggaaaatgtgagtgaagatgagatcatgcaggcggtgtatgggatagaaaagcaatcaagccacccgcttgcaaaagcgatagctgaatttgccgaaagccggggcgccgcgcccgcaggacatctatcgattgacgagacgtccggattcggtgttcaggctgaaatagaaggcgtcaaatggatggtcggaaaagcgggatttgcaggtgaagatgcggcagatgcttttttgcagacatcgggaaaagaattaaaggataaaggctttacactggtctttgtcaagaaagatgaccggattgcgggctgctttgccttaaaggatcaaatccgacctgaagcgaaagccgtgatggctgagcttgaatcactgggcattcaaacagccatgctcaccggcgatcagtctgaaactgcggctgccattgcaaaagaggcgggcatgacgacggttgttgccgattgtctgccggaccaaaaggcaaaagaagtgaagaagctgaaagaaacgtacggcacaatcgccatggtgggggacggcattaatgacgcgcccgctctgaaaaccgctgacgtcggtattgcgatgggcgggggaacggacgtggctcttgaaacggctgacttagtccttatgaaaaatgatcttcacaagcttgtgaaaatgtgcagactctcaaggaaaatgaaccggattattaagcagaatattgttttctcgctctcggtcatctgccttttgatctgcgctaactttctgcaggtgatggaactgccgtttggcgtgatcgggcatgaggggagcacgattctggtcatactgaacggactgagattattaaaataaacatgacagccgcacatcgggcggctgtttttttaatgttcgttcacagcataaacgccggaaaactgatagaatgaataaagagtcactttggtaaggaggaaaatcaaaaaatgaacagattagaacgtgtttcatcttggctgaaaaaagaaggacatgatgcggcgtttatacatacaaaggaaaacgtattttatttaactgatttttacacggatccgcatgagcggttaatgggattgttcctgtttcaggaacaggagccgtttttcgtttgtccgggaatggaagccggacaagcccgaagcgccgggtgggagcatggtattatcggctacggcgatcacgaagatccgtgggagctgatcaaagccgagctcacaaaacgaaatgtgcggcttgattccatcgcggttgaaaaggattcgatctctctttcccgctcagaacagctcaaacaagcttcagggggcgcggcatttgtttcggcagaagaaacgctcaaccaattccgtctcgtaaaagatgagaaggaaatcagcattctcagggaagcggcaaaactcgcggattacggagttgaagtcggtgtcgcggcgcttaaagagggtgtgagtgaaaccgaagtactcgcgcagattgagtttgagctgaagaaaaaaggcgtgcagggcatgtcattttcaacgatggtgctgttcggggaaaaatcaggccagccccatggaaatccgggtgcagaccggttgaaaaaaggcgatttcgttctgtttgatctgggtgttattcttgacggctactgttcagacattacgagaacattcgcataccaatcaatcagcccgaaacaggaagagatttacgaaacggtgcttaaagctgaacaggcggcgcttcaattaagcaaacccggcgtcagaatcggcgatcttgatttaaaagcccgcggcattattgaaaaagcaggatacggagactatttcccgcaccgcctcggccacggactcgggatttcggttcacgaatatccatcaatgagcagcgcgaacaacacactcctcaaagaaggcatggtctacacgatagaaccggggatttacgtgccggatgtcggcggcgtgcgcattgaagacgatgtgttcgtcacaaaagacggcgccgaagcattaacgcagtatccgaaagaattaacgattctgaaatagaaagctttgtgataaaaaaggacggttctggaacgcagcgtccttttttatcaccttttaaatgaaaaaatcatcaaaatgctgaaatggtttgatgtcatgcttttcattcaggggccgcatggcaaggtaactgccgccgattatggccagacacaaaccgattaagcaaagaatccccatcgctgttcttctcctttcaaacgaataggctgtatctgtttctagcttactgtatgaaacgcattccagatcaagggaaaaaaagaaaggggggacgccatggctacgatcagagacattgccggcgctgccggggtttccgttaccacggtatcaagagtgttaaacgatcatccttatgtaagtaaggacaaaagagaaagagtgaaaaaagcgatgcaatcgctcggatatacgcgcaacattcatgctgtgcatttatccaaaggtttttccgatatgatcggcgtggtgcttccgtcggtgaatctgccgtattttgcagaccttgttgcaggtattgccgaggctgccgaagcgtcaggcgtgcatctttctttataccagacagattatcaggagcaaaaagaacgttttgctttatcacaattacaggagcgccaagtggacggcctgattatctgctccaaagcaattcctgatgagcatctgcttaccgtgaaagaaccgctcatcctctgccagtacactgatgcggcggggctttcctccatcagtaatccgcatcgggaagcatttcggcacggtctggattatctgatagaaaagggacaccggaaaatagcgatcagcctggccagaaaaaagggaaaaaacagtcaagtacgcattgccgcatacaaagaggcgctgaagaagatcgggcagccttacagggaagagctggttgtggaaaaggcgctgacgctgcttgacgggaaagccctttttcatagatggaagagctgggatgacaaaccgactgcgctgtttgcagcgaatgatcaagtatccgcaggtctttaccttgaagctaaggcaaacgggatacgcatcccggaagagcttgcgattttgagcatcgacaatcatgatatcagcaagatgttaggtatttccacaatagatatacaaacaaaagaaatgggaaagcaggcttttcacatgcttgagaacaggatcagcggcgggcctccggcaaggaaagttcttgattaccgccttattgaacgatcaaccgtctaaaaaaagaattgacgcgctttccgttcgttttgtacgatatgaggtattgaatgacaaaggagctgaggatcatgaaggggtcctttacagttgaaaaggtattaaataacaatgtgctcatcgcaacacatgatagatacagtgaggtcgtcttaatcggaaaagggatcggctttggaaaaaaacaagcggatgtcattgaagataaagggtatgacaagatgttcatcttaaaggatgaaaaagaacaaaaacaatttaaaaagctcctcggttatgtggacgagacacttgtcgacatctccaatgacgtcatttatcatatcaagaagcggacaagccaaccgttaaatgagcatatccatattgcgctgactgaccatatcgcctttgcggtaaagcggctgcagcagggttttgacattaaaaacccgtttctcatggaaaccgaaacgctttatccggaagaatttcaaattgcccgtgaagtcgtcggcatgattaatgaaaagacgggaatctgccttccggaaggagagatcggctttatcgctctgcatatccattccgccctgacgaatcggcccctttcagaggtcaatcagcattcacagctgatgtcccgcctcgttcaggtgattgaggaatctttccagatgaaagtgaataaagaaagcgtccactatttgcggctgatccggcatatcagatttaccatagacaggattaatcgggaagagcagacaaaagaaccagaaaagttaatgttattattgaaaaatgaatacccgctatgctacaatactgcttggaaactgataaaaatcttgcagcaaatactgaaaaaaccagttcatgaggcggaagcggtttatctcacgcttcatttgtaccgattaaccaataaaatttcataatttcagttgaaaccttaaaaacgtgtcactgattcgatcaggcatgagtgattgagggtaaaaaaacgggaagaacgatcccgttattttgcacaccctttttactcatgccttttttgttgtgtaaaagggcaaatgtaaacggttaaactgaagacttgcgccagtgaattcgttgtcatgaattttcgctgtaaggtcacactagctaacagaggaggtacatcttttatgtttaaagcattattcggcgttctccagaaaatcggccgtgctcttatgcttccggttgcgattttaccggctgcagggatcttgcttgcgttagggaatgccatgcagaacaaagatatgattcaagtcatgcatttcttaagcaatgataacgttcagcttgtggcgaacgtcatggaaagcgccggccaaatcgtatttgacaacctgccgcttctttttgcagtaggggttgcgatcggtcttgccaacggagacggtgttgccggaatcgcggctattatcggatacttggtcatgaacgtatccatgagcgccgtgcttatggcaaacggcagtattccgtctgacaaaattgaacgggcaaagttttttgcggaaaaccatccggcctatattaacatgctggggatacccactttggcgacgggcgtgttcggcggtattatcgtcggggttctggccgcgttattgttcaacaagttttataaaattgaacttccgcagtacctcggattctttgcgggtaagcggttcgtcccgattatcacatcaatttccgcattaattctcggtcttattatgttagtgatctggcctccgatccagcacggtctgaattccttctccacgggtcttgtggaagcgaatccaaccttggcggcctttattttcgggatgattgagcggtcattgattccgttcggtcttcatcacattttctactcgccgttctggtatgaatttttcagctataaagatgccgccggagacatcatccgcggagatcagcggattttcatggctcagatcaaagacggcgtgcagctgacggcgggaacatttatgacggggaaatatccgtttatgatgttcggtcttccggcggcagcgcttgcaatctatcatgaagcgaagcctgaaaagaaaaaacttgtagccggaatcatgggttctgccgctctgacaagtttcttaacgggaattaccgagccgcttgaattctcattcttgtttgtggctcctatcctgtttgcgattcactgcgtattcgcggggctttcctttatggtcatgcagctgctgcatgtaaaaatcggtatgaccttctcaggcggtctgattgactacttcctgttcggaattctgcctaaccggacggcttggtggcttgtcattccggtcggcttaggattagccgtcatttactacttcggtttccggtttgcgatcagaaagttcaatctgaaaacgccgggccgtgaagaagaggctgcggatgaaggtgcgggcgcctcaggcgaagccggcgaccttccttatgaaatcctgcaggcaatgggtgatcaggaaaacattaagcaccttgacgcttgtatcacgagactccgcgttacggtcaacgaccagaagaaagtggataaggcccgtctgaaacagcttggcgcctcaggcgttcttgaagtcggaaacaacattcaggccattttcggcccgcgttctgacggtttaaaaacacagatgcaggatattattgccggacgcacgccgcgccctgaaccgaaagtatccgcgcaagaagaagtcagccagcaggttgaagaggttatcgcagatccgctccgaaacgagcagggtgaagaagtgttcgcttctccgatcaccggcgaaatccatccgattactgatgtgcctgaccaggtgttctcaggaaaaatgatgggtgacggttttgcgattcttcctgaagaaggaatcgtcgtatcgcctgtccgcggaaaagtgctgaatgttttcccgacaaaacatgcgatcggccttcagtctgacggcggaagagagatcctgattcatttcggaatcgacacagtcagcctgaaaggtgaaggattcacttcttttgtttctgagggtgaccgggttgaaccggggcaaaaactgcttgaagttgatcttgaagcggttaaacctcatgttccttcattaatgacaccgattgtctttacaaatcttgccgagggtgaagcgatttccctttcggccgaaggtaccgtaaaacgggaacaaaaagatattgtgaaaatcggaaaataagcatataaatacgccgtgcttgtcagatgacaagtacggctgtatgatataatattgtgtagtaaaatagctttaatttaaaggagaatgataatcatggcacaaaaaacatttaaagtaacagcagattccggaatccacgctcgtcctgcgacagttcttgtacagactgcaagcaaatacgatgctgacgtaaacttagaatataacggcaaaacagtaaaccttaagtcaatcatgggcgttatgtctctaggtatcgctaaaggcgctgaaatcacaatttccgcttcaggcgctgacgaaaacgatgctcttaacgctttagaagaaacaatgaaaagcgaaggactcggcgagtaatgcaagaattaaaaggaataggcgcttcagccggaattgcgattgcgaaagcataccggcttgaagagccggacttaacggttgaaaagaaaaacattgctgatgctgcggctgaagtaagccgttttgatgaagcgattgtacgttctaaagaagagcttgaaaaaattaaagagcatgctttaaaagaactgggacaagacaaagctgacattttctccgcgcaccttttagttctgagtgatcctgagctgttgaacccggtaaaggagaaaatcagcacagattcagtcaatgctgaattcgctctgaaagaaacagcttccatgttcgttactatgtttgaatcaatggataacgagtacatgaaagagcgtgcggcggatatccgtgacgtaacaaaacgtgtgacggggcacctgctgggcgtggaaattccgaacccgagcatgatctcagaagaggttgttatcgtggctgaagatttgacaccgtctgatacggcgcaattaaaccgccagtttgtaaaaggttttacaactgatatcggcggacgcacttcacactccgcgatcatggcccgttcgcttgaaattccggctgttgtcggcacaaaagcggctacagggacaattgaaaacggtgttacggtaatcgtagacggcatcgatggtgatgtgatcatcgatccttccagtgaaacgttaaagaaatatgaagaaaagcacagtgcttacctggcgcaaaaagctgagtgggcgaagctcgtcaatgaaccgactgtttctaaagacggccatcatgtagagcttgccgcaaacatcggcaccccggatgatgtaaaaggcgttcttgaaaacggaggagaagctgtagggctttaccgtacggaattcctttacatgggacgcgaccagcttccgacggaagaggagcagtttgacgcttataaaacggttcttgagcgtatggaaggaaaatcagttgtcgtgcggacattggatatcggcggcgacaaagagcttccatacctgcagctccctaaagaaatgaacccgttcttaggctacagagccatccgcctttgccttgaagagcaagaaatcttcagaactcagcttcgtgcgctgcttcgtgcaagtacatacggaaacttaaaaatcatgttcccgatgattgcgacagtaaacgagtttaaacaggcgaaagcgattcttctcgaagaaaaagaaaaactcgttgaagccggcgtagcggtttctgacgatattgaagtcggtatgatggtagagattccgtctacagccgttatcgcagatcagtttgccacagaagttgacttcttcagtatcggaacaaatgacttgatccaatacacgatggctgctgaccgcatgaacgagcgcgtagcttatctgtatcagccatacaatccggcgatccttcgtctggtcacccttgttattgaagctgctcacaaagagggcaaatgggtcggcatgtgcggagaaatggcgggagacgaaattgcgattccgattcttctcggcttaggcttagatgagttctcaatgagcgctacatccatccttccggcaagaacgcagatcagcaagctttctaaaaaagaagctgaatcattcaaagaaacaatcttgtctatgagcacgacagaagaggttgtcgcattcgttaaagaaacattcaataagtaatacaaaagccagacggtgtaagccgtctggtttttttcatattcggaaaaaaggggggaacaataactttcaacaggagggattattatgacaaaatcatttgcagcgggggatacggtctatgtgatttaccgcaatccgcatgccgccaatgttgcccatattaaagaggcggagatcgtccatcacccgtatcatgagggagaactttctctgtttttatacgaaacctatcatccgctggccgaagatgacgcggtcttttcgacatatgaggaagcggaagcgctttacagcgagctttttgaagaagaccggtatcattgatcaaaggaaatgtttacaacgcatattcactctcttttggacggaaagtaacaacatgagaatatgtaaagggagtgtctgtctatgctgaagccgtttgttccccagcttgtttatatagaaccgagagcgctcgaatacccgttaggacaagagctgaaaaataagtttgaaaacatggggcttgagatcagagaaacgacatcgcataatcaagtccggaatattccgggaaaaaatcacttgcagcaataccggaacgcgaaatcaacattggtaatcggcgtccggaaaacactgaaattcgattcttcaaagccgtccgccgaatatgccattccatttgcgacgggctgtatggggcattgccactattgctacctgcagacgacgatggggtcaaagccttacatccggacatatgtcaatgtggaagagattctggatcaggctgatgagtatatgaaagaacgggcgccggaatttacaagatttgaagcctcttgtacgtctgatatcgtaggaatcgatcatctgacacatacattaaaaagagccattgaacatttcggacaaagcgaattgggacagctcagattcgtgactaaatttcaccacgtcgatcatttgcttgatgcaaaacataacggaaagactaggttcagattcagcatcaatgcggactatgtcattaaaaactttgaaccgggaacttctccgctcgacaaacggatagaagccgccgtcaaagtcgctaaagcgggctatccgctcggtttcatcgtggcgccgatttatattcacgatggctgggaggaaggctataaggaactgtttgagaaacttgacgcggcgcttgatgaaggcgttcggcatgacatcacatttgaactgatccagcaccgttttacaaaaccggccaaacgggtgattgagaagaactatccgaaaacaaagcttgagcttgatgaagaaaagcgcagatacaaatggggacgctacggaatcggcaagtatatataccaaaaagacgaagagcatgctttaagggaaacactggagtcttatatcgaaacctatttcccgaaagcgaaaatcgaatattttacgtaaggcggagctgtcggcatgacggctctttttttgctgcgccaaatggcggaaatttttgatatttatttcaaggtttattcattttcttggccgaaagaccgatataactctcaggaggggatggttatgtttaaaaaaatgcatatcaaaattgctgtgtttgtctcggcaatgcttattgtaacggttgcttttttaacggtttcttcatatttgacattaaagccgatgatgacggaggaagcaaaacgtacgacagagaatgtcaccaattcactcggtcagaacattgagcttcagctgaaaaatgatgagaccgtattaatgagattagcaggcggtgaattgtcccggtcttttctatcagatgggaagaaagaaaccgcgcggctttttaacgatgagttaaaacagatcggacagaatgacaaatatgtcgcgcttgcgtatgtcggaaccgcaaacaaacaaatgtttacatatccaaaggccgattttgccaaagactatgatccgacaaatcgaacgtggtataagatggcggccgaaaaacccgataaagttgtctggactgacccttataaagatgcagtgacgggagacatgattgtgacggcgtcaaaagccattcaaaacagcggaaccgtcgtcggagtggcgagcttagatctgaagctgtcctccattcagagcatggtcaacgagcaaaaggttccatataaaggatttgcgtttttggcggatgaaaacggttctctgctggcgcatccggaaaaacaggggaaaaatatttcggaagatcagacgttaaaagacatcactacggacaaagaaggcatcaaagagctgcaggggaacatggtcgtctaccaaacggtaaaagaaacagggtggaaagtcggaacgcagtttgaaaaagatcagctgatgggagtagccgacaaaatgaacacggtgagcatttttatgtcactgatcgcccttgtgattacgatcggactcagctatttcctagcaaaaacgataaccgggccgattcagcagctgatcgcaaaaacaaattcagtctcagcgggagatttaaccgtccgcgctcagacgaaatcaaaagatgaagtaggcgagttaacaaaagactttaaccaaatggttgaaaatatgaaagagatggtcgaacaggtcaaggcctcctcagaaaatgtgtctgatacatctgaccagctaaccgtcatctcacaggagacaaatgaaacgagcggacaaatcgcaaaagcgatagaggaagtcgccgccggagcgacagagcaagcgtcagaggttgagacgatcaacgaaaaatcggaaaatctctcagtcaaaataaaaggaatcgcagatcgcgcaggcagcataaaacaactctcaaagtcttcagaggatgccagctacaaaggactggacgcgctcgggcagctgctgatgaagtcaaacgaagccaattcagaaacgaaaaaagtagaggcaatgctgaatgacctggaagaacaaacgaaaaacatagaagaagtcgtgacggcaatatccgctatttcagaccagacgaatctcttggcgctgaatgcgagcatagaagccgcaagagcgggagaaagcggacggggctttgccgtcgtcgctgaagaagtccgcaagcttgctgaacaatcagctctttcttccggccatatcagtgagacggtccgtctgattcaatctgagacaaaagaagcgtcacacgcgatgattgaggcgagcagaatgaatgatgaacaaaacagcgccattcatgaaacgggtgaggttctcaatctgatcacgacggaaatgcagtctctcgttcaaggtatagatcatatttacaatgacattcaaaaaatgagtgaagaacaagccgcgattcaagaagcgattcaaagcatctccgccatttctcaagaatcagcggcagccgcggaagaagtgaatgcttctactgatgaacagctcgttacgcttgaaaaagtgaagcaatcgactgatatgttaaagagcgcaagcgaagatctgatcagcgccatttctaaattcaccttgtaacgcggactctatcagcctataatatggtaatatagacatgaaagagtgatatatgaatcgcatcaggggaggaaagcgcagtgaacaaaacggtcggatttatcggtttaggcgtcatgggaaacagtatggcatcgcacattttagaagcgggctatcctgttttagtctacacacggacgaaacaaaaagcggaagagattctgaataagggagcggtctggcaggagacggtcaaagacctttcagagaaagctgacatcattattaccatggtcggctatccgagtgatgtcgaggaaatctatctcggcgaaaacggcattctccggcacgcaaaagaaggggcgtttgtcattgatatgacgacatcaaaaccatctctggcgaagaaaatagcggagaaagccaaagaaaagtccattcacgccctggatgcacccgtttccggcggagacatcggcgcgaggaacggaacgcttgccattatggccggaggagaaaaagaagcgtttgaagcatgcctgccgcttttctccgttatgggggaaaacattcagtatcaagggccggctggcagcggccagcatacgaaaatgtgcaatcagatcgcgattgcagcgggaatggtcggagtggctgaagcgatggcttacgctgaaaaatccggtctgaacccggaacaagtgctgaaaagcattacaaccggagcggctggcagctggtcattgtcaaatctcgccccccgtatgctgaaaggcgattttgcaccaggattctacgtgaaacactttattaaagacatgggaattgcccttgaagaagcggagctcatgggagaagagatgcccggattggcgctcgccaaatcattatacgacaagctttccgcgcaaggtgaagaaaacagcggaactcaaagcatttataagctttgggtgaaataaaaaagattgcccgcaggggcaatcttttttattatttattttccgataaattgctgtgtccagatgtttcctgattctacataaccgacaccgatttgagtgaactcaggattcatgatgttctttctgtggccttcactgttcatccaagctttaacgacagcttcaggagtcggctgtcctttggcgatattttcaccggcggttttataagtgattccgaaagacttcatcatatcgaaaggtgagccgtaagtaggactttggtgatcaaaatagtttttgtctttcatatcttgtgattttgcgtgagcggatttgcttaatttttcatcaatctgcagaggttttaagccttgcttttgtctctctgcatttgtcaattcaacgactttcttttcgtacgcactgacagatgaaggagttttctcgctgctgttgtttgtgttatctgtctgctttgcattgtcagccgtctggttttgatcggctttcggtttttcggcagctgtcggagccgtttttgccggtgtttctttttgaacgtctttaactgtcatatcagaatgctttgcgtgtttttgcagcagctgagtcagttctttctcatttttaacgttcagctttttcacgctcgttttcatatgtagtttttcaacagcctcttgaagagtcagatgctgtacggtgtttccttttttcacagtaacgacgtgctggcatgacagctctttggcagatgcctgctgaatgcctccgaatgtaatcaaactgactgccgcggcggcagataagagaaatgcttttttcataagtttatagcctcccagagaagttgtttttttctacatgaaaaatcttatcacagcttttttgtcataatgcaggcagccatttcctttgacaacaaactcttgtcataattgtaattgagcgcagaaaaacggctctataccgggaaaaacgatctgtatttattttttaaaatccgttacatctcttcaaattatttgaagtgttagatatattttaagataatttgatcttgacagttttttttacccgttttcgctgtaacaacttttacaaaaatgttacaattaaaatctgtttatgtaaatatattcaatgatttgagaggtgtaacagaaagtggctgaagtcgcgcgcgaaccaaagaaaaaaacgaaacgttacagagcgctgagaatgaatctctattttttgattgtttttcttctctttacggcactgatttttaaactcggcatcgtccagattgtcgaaggggataaacaccgccaggatgcggagaaggcaaatgcaaaaaccgcctattatccgacaccgcggggaaagatgtatgacaagcggaacagggtggcggttgataaccaggctgtgcctgaaattgtatatgtatccacctcaaaaacctcggcaaaggacaaattgaaaacggcaaaaaatctcgccgcactgattcatattgatactgaatttatgaaggatcgaaatatcattgattactggcttgccgcacatccgaagaaggcggaaaagcttatgaaggattcagaaaacagcctgaaatcccaagaagtgtacaaacgccagattgaacgcgtcccgaagcaggagattgatgcgatcaaaaaagataaaaaagagctggaaatcgcggcgatttatacgcgtttttcaagcggcaacgcttatcagccgcaagtcgtcaaatcaatggacccgaataagctgaacggaaacggaaacagcggttcactgcttgacgagcatgaaaacaacaagcaaaaaccgaaaagcgacctgacatatgaagaagtttccgtcgtatctgagcacctgaaagagctccccggcattgacgtaatcaatgactggacgcggaaatatccgtacgacaaaacactgtactctctgttcggcggtgtgacgacaccggaacagggattgttgggcgaacggaaagattactatgtcacaagaggctattcactgaatgaccgagtgggaaaaagctacatcgaatatcagtatgaagactatttaaacgcgcataaagaaaaagtagagtatgtggaaaacagcaaaggtgaggtcgtcagccaaaagcccgtcgatgaaggcagcagaggctacgatctgcagctctcgctcgatatggaactacagtcgaaagtcgaaaaagtcattgaaaaagagctgagaagaagccgagccgcaggcaactatatggttgacagaggatttgccgtcatgatggacccgaacaacggggacattctctcaatggcggggaaacgaatcgatctcgaaacaaataaaacacaggattttgcgatcggagcatttacgacccaatatgagatgggctcttctgttaaaggagcgactgttcttgcaggttaccaaagcggcctcccgcattataaaacgtttgtcgacgcaccgcttaagtttaaagacggcacggaaaagcaatcgtggacacaaatggggaccattactgagcttaccgcgctgcaaagaagttcaaacatatatatgtttcatgtggccatgcatatcgcgggcattacttacgttccgcacggcacgctgccggccggattagacgatattaagaaaatgcgcaactattacgcccaatttggcttgggtgtgaagaccgggattgatcttccgcaggaatcagcgggcatgcagtcaaatccgcaaatggtcggggggttgctgcttgactttgcgatcggacagtttgatacgtatacgccgcttcaaatggctcaatatatttcagccatcgcaaacggcgggtatcgcgtccagccgcggatcgtcacaagcattcatgaaccggacagcaaaaacaagattggaaaagcgattgaacagcgcgatattaaaattttgaacaaagtaaataacagcccgagcgattttgaccaagttcataaaggaatgaagttggtcacaagctcacctcaaggaacggcttattcaacattccaaggttccggcgccgatgtttccggaaaaacgggaaccgcgcagacgcactattacggcacgaacaaaaactggtgggggcaagagacgtataacctgacctttgtcggctattatccgtcagaacatccacgagtggcattcagcgttgtcgttccgtctgttcaggatgatcacgatcatgtcagcaaaaacattgccaaaggagcaattgacgcttacaaagaacttgaaaagaaatacaataaaaaataacaaatgaaagggcggccgaacatctcgtgcgccctttctttcattcaggaaaattgacgttcacaataagaatagaaggagaatgcttattttttagcgaatcaatctagtggaatttctttttataccagtccgtgtccagcctgcagtgcgagtataatgcaaaggagggattctgtggaacaggatactcagcatgtcaaacagtttcaatcgaaaaccgatcttcatgccgttttgacgtctaacgggcgtattatgtatatttctgcaaactgcaaatcgtacttcagttattctcaggaagagatgatcgggtcatttctcaaaacgttcctgcatgaagaagatcaatttttggttgaaagttacttctataatgagcatcatttgatgccttgcacctttcgtcttattaaaaaagatcataccatcgtatggcttgaagcgggtgtggaaattgtcacaccgcaaatggaggggacggatcgggaaatcatcctcaaaatcaaggtgcttgaggagaagacgccccgccggccttatatgtatgaacaaaagaagcaaaaggcagaacaacagtcggaagatgcggctggaaacggcgaattcgagcgtcttgtcgaaatgctgccgaatcctttatatgtcagcatcaacggcacaatcgcctacgccaacaatgcgatgcttgccatgctgggagccgataataaagacgaggtaatcggcaggcgctcttatgagtttattgaagaagagtatcacgacattgtgaaaaaccgaattgtgcggatgcaaaaaggaatggaagtcggaatgatcgaacagacgtggagaaggctcgacggcacgcccgttcatttagaagtaaaggcggcaccgacgacatataaaaatcagcgggcggaattgctgcttctgattgatatttcttcacggaaaaaattccaaacgattctgcaaaaaagcagagagcgttatcagctcctcattcagaattcaattgatacgatcgccgtgattcacaatgataaatgggtattcatgaatgagtcgggcatttcgctgtttgaggctgaaacatatgaagatttaatcgggaaaaacgtctatgatcagcttcatccctgtgatcatgacggcgtgaaacagcggatccaaaatattatcaaccgaaagaccgagtcagaaattattaagcaatcgtggtttacctttaaaaaccggctgatctacacggaaatggtctgcattccgacgacgtttttcggagaaacggccgtgcaggtcattctgcgtgacatttctgagcggaagcagacggaggaattaatgctgaagtcggaaaagctgtctatcgcagggcagctggcggcgggaatcgctcacgaaatccgcaatccgctgacggcgatcaaaggatttttacagctcatgaagccgacgatgggggaaaacgaacattactttgaaattgtgttttctgaactgagcagaatcgaattaattttaagtgagcttttaatgcttgccaaacctcagcaaaacgccgtgaaagagcgtgtaaacttaaagaaaattataagtgaagtgaccgctcttttagagacgcaggcgaatcttaaagggatttttatcaaaacggattacgaacatgacagcatgtatattaacggtgatcaaaatcagctgaaacaggtgtttatcaatctgattaaaaatgccgttgagtcgatgccggatgggggaacggttcacatcatcatgacagaagatgagtattccgttaatgtgacggtgaaagacgagggtgacgggataccggaaaacgtgctgaaacgaataggcgaaccgtttttgacaacgaaagaaaaaggaaccggcctggggctgatggtcacattcaaccttattaaaaaccaccagggagccatccaagtagacagcaaaccggatagaggcacggcctttcacattacattcccgaaacaataaaaaaacaacggcgttatgccgttgtttaaatagtctgcatggattctctcgtttttaaaataaatgcttccagccggtccaagccttctctcaatgtatccagtgaatatgcgaatgacagcctcacatacccttcacccaattttgaaaacgagctgccgggcactagagccacacctgcatcctctaaaagagccatactaaaatcaaacgatgacattccgaatgacttaatggaagggaagatataaaatgcgcctgacggctttacgacgtcaagccccattgaaacaagacggtcatatacatagtcaagccgctttttatactgttctctcataataagcgcatcatcaacaccgtttgtcaccgcttcaagagccgctttctgagagattgaagacgcgcatgtcacactgtattggtgaacttttaagatgtgcttggcaatttctttcggtgcgaaaatgaaaccgattctccagcccgtcatgctgtgtgattttgacaggccgttgatgacgatcgtctggtctctcaaataagacgcgatcgaataatgcggtctgtcataggttaattcgctgtaaatctcatcagacaggacaaaaacatttctgcccttcaggacggctgcgatgttttgcagctcttcctcagacaatgtcactccggtcgggtttgacggataaggaagaatgacgcattttgtttttggtgtcagcgattcttcaatgagccgcgccgtcagcttaaatccgtgtgtcgtcgtatccacatggaccggaacggcgcccgacatgcgaatgatcggttcgtagcccggatatatcggtccggggagaataacttcatcgcccggagataaaatcgtccgcaaagacgcgtcaatcgcttggcttgccccggttgtgacgatgatttcagtttcagcttcataattcaagtcagcttttttcttcatataaagctgtacggcctgtctcagctcaaggccgcccgcgttcggagtatacgccgttgcgttctcgtcgattgcctttttggcagccgctttgacatggtgcggcgtgaagaaatccggctggccgatcgtaagcgaaatgacattgtcgtgctgagctacaagatttgagaatttgcgaattcctgaaatttcaatttcttttacattcggattaagcaaatgttccataattcatcaccttatactatatattgagtttatcctattttaccactagctgagcatttgtcatctttttattgaactatcccgagtatatgtccgatatgtgaaaacataccttctttcagaaaaaaataagacaaccagctgaaatgattgtcttcattgtatcatgatctatctattgtgatatgtggcgaatgtcattaatacccgtattcaaagctgacgtcttcccgccataagatgtatggagcgggcttgtcgggacgctctttcgcctcttttttcatttgcaggtaagccgttttgctgatatcttctaacaccgtcatttgatcttggtcgaatatgactactgtacccatttattacacccttcttcctgaaaaatccttgactattttaccactcgatgtcaaaaagtcaatgggatatcagaaaaaagcatttttttataaagagttcatggccagttggaccgaatacattcactttttccgtttccagccgatatatacagtacaatactgaatgcggatagcgagggattgaattgtctttacaacaatacgatattttattggattcaggcacaaacgaattaaaaatcgtcaaatttgaagtaggcgtcaatacatttggcataaatgtgatgaaagtccgggaaatcattcagccggtagatgtcacatctgtgcctcagtctcataaagacgtagaagggatgattaagctgagaggcgaaattcttcccgtcatcagtctgtattcctttttcggcgttgatgccgaaggagcaaaagacgataaatatatcgtaacggaattcaacaaacggaaaatcgtctttcacgtcggttccgtttcacaaatccacagggtgtcctgggaggcgattgaaaagccgacttccctgaaccagggcatggagcggcatttaacgggaatcatcaaactggaagacacgatgatctttctgcctgattatgaaaagatcatttacgatattgaatcggcatcgggagttgagacttatcatgtccatcaggaaggatttgatgaaagacgggcgggtaaaaaactgatcatcgttgaagattcgccgcttctgatgcgtcttttgacggatgagctgactgaggcggggtacagtgaaatcgttacgtttgaaaacggaaaagaagcgtatgattacgtcgtggaactgacggataacggagaaaacctgtcagaccatattgacatgattatcagtgacattgagatgccgaaaatggacgggcatcgtttgacgaagctccttaaggataacccgcaaagctctgatgtgccgattatgattttctcgtccctgattacggacgacctgcgccaccggggcgaagtagtcggagcggatgaacagatcagcaagcctgaaatcagcgagctcattaaaaaagtggatacgtacgtgattgaatagaaaaaagccgatgcatgacgcatcggcttttttgcggcggaattaaaaataactctcaccaagttttttaaatacgggtttatgataagcgggctgctgcctgttggcggcaagcggtttttcctttaagcccacatatttttgcaatacgtttttcgcttttgtcaaagacatttgtgctttaggattgcggtacgattgatttaacgtacctaaatgcggaagatgctggaagtcttcttttgttggaggcatgtgaaaatagtagtctccgatagagataagtacgtctgactgctgttggctaaacctgggattatttgaaaagtgaagccctatttttttccctttgccttctttcacaagcttttgtaatgcccgttttttcagcagataaaggtatttagggttgggggcggtttttgcatggcggttcacagtataaacagcttttgaaagattctcgatggttggctgcagctctttcgaataagcgtggtcgtccattatttctctcctttgcattgatcaagttcatatatagattatacttttttagcgttgaaatgcaaatattgattataaaaatacgcctttttctgatgaaaagggcgcatctttttcctttattagacaggattcgcatgtttttcggaatcagcctttaatgattgctgcacatcgacctctgctgcctcggcgctgtatttcggaagagcgataaaatagaacacaaataccgctaaaatcacgattcccatgccgtaataaaggtaatcaatattggaaacgaatttcggaaataacagggcaaccagtccgagtgtaatcgattgggcaaacatcataaaagggtcctgccagccgctgacccggcccattattttcggatgaacaattttcggcatccagccgccgatggcgatattgacagggccgatgcacatgccgaggacgaaagccgccgcataataaatccacagcttatccgtatagccgaggacaaaaatgagcagtccggctgccaaaataggaatcgacatcaaatgatgcggtttgacttttttcgcgatcatcgttccgatcacacttcctgcaagcaggccgaagccgagtgcgacggtgaagatggaagtatgtgattcgtaatgatcaggcgcaagtccgtatttcatcgtaaacatcggcagtacggcaaagccgccgttgacaaaaccaaagataaaaaagccgaaaataagggaagcaagcaatttgtttttaacaatatatacgatcccttccttaaaatcagcgaccgagtctttcagaaacgaatctccccatttaaaagggccgttcggctgacgggcttctttcggaatgcggcaggcgcggatcagaaagcctgatacaataaagctgacaaaatcaaggataatggctccgtgaataccgatcgttttatacataaacgcgcctataccgacgccgaataccatgaagatgctgaacaggatctggttaagtcccgccgctttcgcgtaatgctccttaggcagaatagcttgtacaaggctggcttccgccgggaaaaagaacttggtcacggcgcttctgatgaacaaaatacagaacacgagagggatgctcccggtgtatagtgcggcaaacaatacgatcgtcagtccggctctgatccagtcacaattctctgcgacctttttcctgtcaagccggtcagctgcgacaccgacaatcagaaatacgaaaactgtcggcagtgaatacatcagctcagccaaagtcgtgtatgccggctgatttgaaaaatggtccagcaagtaaaaagcgaaagccatattacctacagtcgttcccatttgagaagcgagtgctgcgaaaaagagacggacaaaattgcgatttttaaatatatccataaacacgctccttaccctaaaggtcccactgtaatatattatcatcagctcgttccattaacaaataagatctttctatcttataatagtcacccttgttccattaggaacggcagcggcaagtttagtgacgtcctgattatacatccggatgcatccttttgataccgctttgccgatggaggaaggattatttgttccgtgaatgccgtaatgaattttagagaggctgagccaataagcgccgaacgggcctccgggcttaggctggcggttcacgatgtaaaattctccggtcggcgtggtcgtcaatatttttccgactgcgatggggtacgtacggatgagcctgccaaggcggtataactccagtttcttcgctccgatatacacgatgatggagtagggaatggtggatgggtcaggaagattcggtatgataatgtgctgtcccgcgtatatgaccgattggattgagggatttgcctgaaggagagcagcagtgcttattctgaagtcttgcgcaatgcttgagatggtttctccttgtttcacttgatatgtcagcagtttcatcaccctcctttttgctcttttccatatacatattacggagggggtgtctgtgcatcaggataaaagtcttatttttgctcggttttcaatgtgaacagcgtgatttccggtctggctaaaaatcgatacggcagtcttgtcgtaccgagcccgcgattgacgtaaacggctgtgtcatgaagcgtatacatgccgtcggtatacgtttttccgtaaggaggcgtaatgagagggccgaaaaacgggagctggacctggccgccgtgagtgtgtcccgacagctggaggtttacgggatatccgcctatctcgagagcggcatcaggctcgtggacgattaaaatggaaaacgcatcttcggaaaggcgggacagggtgccttcataatcgggttttccgagcattacatcatccaaaaacgcgagttcaatccggcttccgtctgtcagctgcacctgacgatagccgtttcgaaacacttgaaaatcagcagcttccatcagagccttgtacgtgttcgtaccgtagcctccgtggtcatggtttccgtaaacacaaagtttgccgaagggagcttcaagattttgcagcacggcgagtgcatgctggtgatcattaaataaatgcggcttatcaattaaatctcccgtaaagatgagcagatcgggtttcagctgattgattttttccgctgctttattcaagtcaccggatgtatacacatcactgagatgcgtatcgctgaattgaacgattttaaaattgtcaaagccgcgggggatcaggcggttggtgattgtatgccgggtgatttcaatcatgcgcggttcaatataccgggcatagccgtagccaccgcaagccgttgcaagagctgcacccaaaacaccgaatcctctttttaaaaatgttcttctggtcattttctccatatgtaaaaccaacctttgtcagagtttttctattatatcatcagcttggctgaaaaatcccttctcagcatgtaatgacgcggaaagacatctatgataaaattatgaatgattattcattcaataaaaggggtgggtttgttatggataagaaagcggtaatcattacaggcggttcaagcggcatgggaaaagcaatggcgaaaaaacaggctgaattaggatggcacgtcatggtgacagggaggaaccatgaagcacttgaggaaacaaaaaaagaaattgagacctttgaggggcaggtcgcctgttttcaaatggatgtccgttctgattccgccgcttcagacatgattacagaagcgaaaaaagtctttggccggctcgatgcgctgattaacaatgcggccggcaactttatttgcccggcagagaagctgacgcccaatggatggaaagctgttattgagattgttttaaacggcacatttttctgcagccaagccgcggcaaggcattggatcgagcaggagcagaagggcgtcatcttaaatatggccgctacatacgcatggggagcgggagcgggtgtcgttcattccgctgcagccaaagcgggggtattgtcactgacaagaacgctggccgttgaatgggggagcaaatacggcatccgcacaaacgcgatagcacccggcccgattgaacggacaggcggtgcggagaagctgtttgaatcggaaaaagcggtgtcccgcactatgaacagtgtgccgctcggccggctgggtacaccggaagaaatcgccgcgttggcagcgtttttgctatctgatgaagcgtcctatataaacggggattgtatcacaatggacggggggcaatggctgaatccttatccgttttaatttttcatatattgatgattttgcaaaacaagcgaacgttaaagccgccgttcgcttgttttattttctattcgaaattatgatataattttgaaagattaaggggcggttaattgaagaaattattaaaatggttcgttgtactatttgtaagcagtttagctatcatctttaatatttggtactttattatttgtgcttttactccggagtattatcaaaataccaatcttacatctgatgaaataatcagatttgaaaagctatatcacatcgattttcctgatgaaacgaaatgtattaaagccagggagtatttgagtgggctcggaggcgatacatcggctgtattatatgtgtctctgccaaccaagctggcggaaacaattttatctgattatacgtatatgccagtaaatcatactgatcatgccggttcaatgtatggagttgacgtttccgagagtgttggcgggttaacaactcttacatttggcactttagataaaaaaggaactttctttcagttgaaacatgatgatgattggatatttaacagcactgattggagccattatttttggacagctgccggttataatgctcttatatttatccttttatttgtgattgtgaaacaaatgaataacgtccttaattaaccggtctgaagagtgatcttaaaaatatcccccttttattttaagctgctgccatttgcctccttttcccctaatctaaacatttgtggtgctgatataattgtgtataatcagacaaagatagagaagcaggtgataacatgttggacccacttgatatactgacgaatattgatgatgtcattccgtattaccaagcgatttttaacgctgaagaacaaagagtcgtaggctatgaggtgcttgggcgtattttggcagatgcggagattgagagcctcgggtcgtttttcttagattccggcattccggaagaatataagcttgaggtcgatgacagagtcatcaggcaggcgctggagcggtttaaagaagctgatcgtgatctgttgatttttatcaatcaggatgcgaatgtattgatgcttgaccacggcgaaagctttcttgagcttttgaaagaatacgaagagcagggcatcgaattgaaccgtattgtgcttgagatcaccgagcacaatttcgaaggcgacattgaacagctgtaccatatgcttgcctactatcgtacatacggcattaaaatcgcggtggacaatataggtaaggagagcagcaacctggacagaatcgcgctcctttcaccggaccttctgaaaatagatttgcaggcgctgaaggtatctcagccgtcaccatcatatgagcatgtgctgtacagcatttcattgctggcgagaaaaatcggcgccgcgctgctgtatgaagatatagaagctgatttccagctccagtacgcatggagaaacgggggccgattttttcaaggctattatctgcaggcgccgagcggtgattttatagaccgcagcctgttaaaagaacgcttgaaaacggagtttcagcaatttatcacgagagaaaaaaagaagctggaaacggtatacgaacactctgagaatttttataagcgggtcaatcaggcagtttccgagctgaagaaaacccatcaggcggacgatgagtttattaaaaaactggcggaaaacctgaccgactgctgcttcagaatttatatgtgtgatgaagaaggctatcagctgacgggaaatgtgttcaagcagtccggcgaatggctttatcagcctgaatacatggagaaaaactggagctggcgtccgtactttttagaaaacatcatgaagatgcggaattcaagaaaaggctttttcagtgacctgtacagtgatattgagacaggtgagatgatcagaaccttttcatacccgatggatgacaatatgtatttatttatcgatctgccttactcttatttatatgaacaggacgggttactttaaagcggctgctgtatgccgcttttttttataaatgtgaaaaagttttaaaaaacgattgacaatgatagtgataatcattatcatttagttatagagagaagttactctctgttccccaacccctctatcagatcaagatccgaaaaagcttggcgctacccccgccaagtttttttatgctgtctcctcataaaagggcttctcctcacatacatctgacaatggcggctcaaaaagtgaaaaattatttttgaaaggtgtatgacattccgaaaaaagcttcaaactattcgaaaacacggttttcccgtttattttcttattgaaaatccagcgggaaaatgccatcccggtctactttatggtatgatgctctgtaggacttgtattataataaatacttgttgatttgaagttgttttttgaaaggagtctttttttagaatgtcacaattaatgggtatcatcacgcggctgcaaagtctgcaagaaacagcggaagcggctaacgagccgatgcagcgttattttgaagttaacggcgaaaaaatttgcagtgttaaatatttcgaaaaaaatcaaacgtttgaactgacggttttccaaaaaggtgaaaaacctaacacatatccgtttgataacattgacatgatttctattgaaatttttgagctccttcagtaatgtgatttgatttttcaggctgaccaagcttccggtcttccgcaagcggagctttattaaattatgcaaaggaacgtgcttgttcgtttggttgtaaactctggaaagaggagtgtccgtacatggctgattcttttctgttttataatctttctgaggcacagatgacctttcaagacgtgacggagcggctgaaacgctttgtcaataaagacccccgttcagcatacgtgctgtctgtagggactgattcacaagtttaccgcgacttcacaaagtttattacggctatacacttgcaccgtacaggcaagggagcttggggctgtttgaaaaatcacgaccttgcaagaccgatacatagccttcgcgaaaaaatctcgctggaaaccgcgttcagccaggagatggctgcgcatatcctcgacggccgtcttatggaactgacagatttgctcttgccttttgcggatgaaggggcggatctttcatttgaagtgcatctggatatcggtcaaaaagggctgacaaaagaattgatacaagaaatgaccggccgcattacctcaatgggcattgaagcgaaaatcaagcctgattcctgcacagcattcagttatgccaatcgttacacaaaataatatttcatacagaatccgcaaaatgtcgaattatgcggttgacgatttttttctgtttacttattctagcggtagagctgaaagcaaatttcaccttgctttcagaggtattcagttaaaaatagggggcctgattacgtatgagtcttatcagtgaacgatttacggaagaagaacagaaacttctgctgaatatcctgatcaatcaagaatatgccattgagcttttgaccagcgaaatcaacgatatagaagcagggtcaaaaagcgttgatggaaccacttataaaaaactcgtaacgctctatgaccgttttcggaacgaaaattaatcagcggcctataaattgatactcgattgcaaagagtatcttttttattgacggaaacttttcgacaaaaaatgataatgtttatattattgcaatatagggaatacatgctttgatgaaaaatgtaaaggggtcgaagtgacatgattagcttacaatcagatcagcttcttgatgcaacagtcggacaatttatgatcgaggcggataaagtggcgcacgttcaagtcggaaacaaccttgagcatgctcttttagtgctgaccaaaaccggctataccgccattcccgtcctcgacgcttcgtaccgtctgcacggtttgatcgggacaaatatgattatgaacagcattttcggacttgaacggatcgagtttgagaagctggatcaaattacggttgaggaagtcatgctgaaagacattccccgtctccacatcaatgatccgattatcaaaggattcagcatggtcattaacaacggctttgtctgcgttgaaaatgatgaaggcgtctttgaaggcattttcacgagaagagtcgtgttaaaacagttgagcagccatatcaggtcattgaataagtaggctcgcacgatcagcctatttgttcttttgtatgccggaaaaagaaaacgcatacatatgagtggcgcttgcctcggcagcctttattttattagaatggtagataagaaatacgaaaaggcattgaaaaggaggacgacatgcagcttcaagagcttcatatgctcgtagttttggctgaggaattaaacatgaggaaggctgccgaacggttattcgtgtcacagccggctctgtcccagcgattgcagaccattgaaaaagcctggggaacaaagatctttctaagatctcaaaaaggacttacggtaacgccggcaggagaaaaaatcatacaatttgcaaatgacgtcacggatcggcaagaaagaatcagagaaaacattgatgaacttgagggtgagattcacggcacattaaagcttgccgtcgcctccattatcgggcagcactggcttccgaaagtgttaaaaacatatgtggaacgatatccgaatgcaaaggtctctctcattacagggtggagcagcgaaatgctgaaaagtctgtatgaagatcaggtacatatcggcattatccggggaaatccggaatggaaaggccggaaagattatttaatgaccgatcatttatatttggttgatacggaaatttcctgtattgatgatattgcccataccgatcggccgtttatccaattcaaaagtgacagtacatattttcaggaaattcagcattggtggcatcaaaaattcaaaacctcgccgaaacagaccatcctcgtcgatcagattgaaacgtgcaagcagatggcgctgcatgggatcggttatgccattctgccgtcagtcactttagaagaggaagacaaagtaaataaaatgcccctgcttgatacaaaagatcatccgatcggccgtgacacatggctgctcggttatgagccggcatttgaattaaaacaggtgcaggcttttgtttctgtcattaaagatatgctgaagcaggaacgcccattttagaaagacagcaatcatgctgtcttttttttattttttattgacaatgaaaatcattatcatttaaagtgttatatatgttaatgaaaatcattatcaattacgaggtgatcttatgcagaaagcattaatgatatacgcaagcatgtcggggaatacagaggatattgccggtattataaaagaaacactgagcgggcatcagatagcagttgactgtctcgacatggatgaggcaaatgcggattctctcgaagcatatgattatgtttttgtcggcacgtacacatggggggatggtgatcttccttacgaagcggaagatttttacgaagatattctgcacagccagctcaacggactgaaaacggcctgtttcggttcaggcgatcacgcctacccgaagttttgcgaagcggtcacgctgttttgcgatgcgtttgaacaggccggagccaatttatatccggaaacgctgaaaatcgagctggcgcccgagacggctgaggatcaggaatgctgcaaagaatttgtccgcggttttcttgcatgggccgctcgccacggagaccggtgccatgtttcataaaggcgcgacggctgtcatggcatcagtgacctcaggatattttgtcgcggtgaaagacgaaggtatttttcatttttcggcggaagaaggttggaaaagactgttccgagtgaaaagcaggattcatgtgctgacttacatagggccctacatattcgcggctggagaaaaaggcgccgtcctcagatcagccgatcagggaaagacttggacggcctcccgatttccgaccagcgcctccgtatgggccgttgccgggcggaatgacgggtttgtctgtgcgcacggcacatattgcctctacttatctgatgatttcggcgtcacttggcatgtggctaagcccttttcacaattaaaggagccgcctgtcatccgttcgctttgtttacacggtcagacgatttatatcggcacccggattcatatgaatcatggcggcatttgggcgtatgatctgacggaagaccgcatccggcgtataagccgcgaaaggcagcgcatgacggcttcaatgatgatgtatcagaatgactggctcattgcagcaaagggcgcggcaaagggagaacggggggaggttgccgtccgaaacgtgcggacgcaagaggagtttgccattacagccgggcccgccgtacgggaaaaatcatttctcgacgtttctgaggataacgggattatttatgttacatcatcacaggacgaaaacggattttcgcgtatttatcaagctgatctcgccgccggtgaattaaagtggtttgatacgatccgcggtcacggatggcgggtggcaaaccgggaagaaaactttttttgcgcgggcctttacgaaagtaagtttgtcagaccgtatgaggcggttcggctcgcacattagtttttatgcataaaggagagacgaagatggggaatgtactgcttgtttacgctacaatgtcaggaaacaccgaggcgatggcggatttaattgaaaaagggctgatccaagcacaagcatccgtagacagatatgaagcgatggatattcatgccgaactttttaatgattacgagtatattttattaggcacatatacgtggggagacggggatcttcctgatgaaatgctcgatattgctgaagatatggaaaacctggagtttacgggaaaaacatttgctttgttcggttccggagatacgtcctatgagtttttttgcggagcggttgacgaattggaaaaagtaatcacggcccgcggcgggcgggtggtgctgccgtcggtcaaaattgaaaacaaccctgagggcagtgaggaagaagagctccgggaattcggaagacagtttgccgcgctgtgcagccagccggcagaataaaggcttgttcctttttttcttgtctttgtatccttcctttgttacagtaatgaggtagaaaatcagaggaggacaatacatatgaaaatgatggatgcaaatgaaattatttcatttattcaaaatagtacaaaatcaacgcctgtaaaagtgtatgtaaaaggcgatctcgaaggaatcagctttggcgattccgctaaaacattcctgaacggccaatccggcgtcgtttttggcgagtgggctgaaattaaaagcgcaatcgaagaaaacaaagacaaaattgaggattatgtcattgagaatgaccgccgcaactctgcgatcccgatgcttgatttaaaagatgttaaagcgagaatcgagcccggcgctattatccgcgaccaagtcgaaatcggcgacaatgccgttatcatgatgggtgcgtctattaatatcggttcagtcatcggcgaaggtacgatgattgatatgaacgttgttctcggtgggcgcgcgactgtcggcaaaaactgccacatcggagcgggttctgtattagcgggcgttattgagccgcctagcgctaagcctgttgtcgtggaagacgacgttgtgatcggcgcaaatgcggttgtgcttgaaggcgtaacaatcggtaaaggcgcggttgtcgctgcgggagccatcgttgtgaacgatgtcgaaccatataccgttgtagcgggaacacctgcgaaaaaaatcaaagatatcgatgaaaaaacaaaaggcaaaacagaaatcaaacaggaattacgccagctgtaaggaatggtttgatagaatgggcgtggatgataaaatccacgccttattcttatctcaaggaggaatacatatggaaaaagagcggctcattgccatccgaagagatctgcaccgcattccggagatcggctttcaggaatataaaacccagcagtacctgctgaatctattgaaccaatatccggaggaaagaattgaaattgaaacttggagaaccggcatctttgtcaaagtcaacggcacggctccggaaaaaatgctcgcctacagagcggatatagacgctctgtcgattgaagagcagacgggacttccgtttgcatctgaacaccccggttttatgcacgcatgcggccacgatatgcacatgaccatcgcgctcggcattattgatcattttgtccatcatcccgtcaaacatgatctgctctttttattccagccggctgaagaaggaccgggcggagcggaaccgatgcttgaaaacgatgtgctgaaaaaatggacgccggatttgattaccgctctccatatagcacctgagcttcctgtaggcacaatctccaccaaaagcggattgctgtttgccaatacgagcgaactcgtcatcgatcttgaggggaaaggcgggcatgcggcatatccgcatacagcagacgacatggtcgttgccgcgagcacgcttgtcacgcagctgcaaacggtcatatccagaaatacggatccgcttgacagcgctgtgataactgtcggaacgattaccgggggcacggcgcaaaatatcatcgcagagcatgctcatctggagggaaccatccggacgctttccgaggaatcaatgcgtatggtgaaaaagcggattgaagagcttgtcaaaggaattgaaatcggcttccgatgcaaaggaaaagtcacgtatccgtccgtttatcatcaagtttataatacaagcggcctgaccgaagaatttatgcaatttgtcagcgatcatcagcttgctgacgtgaaaacggcgaaagaggcgatgaccggagaagatttcggatatatgctgaaaaaatatcccggctttatgttctggctgggggccgattcatcccatgggcttcatcacgcaaagctgaacccggatgaagatgcgatggaaaccgcggtaaatgtcatggtcggatatttttcgaagtatgccaattaaatccgaaaagaagaataatctaacaaaaattgagcattctacataacggaggtgttcaatatgacgaaaaaaattggaattgaacaatctttatcggatgtagaacaggcgttaaaacaaaaaggatatgacgtagtgatgatgaagactcctgaggatgcgaagaattgtgactgctgtgtcgtaaccggacttgacagcaatgtccaaggaattgccgatacgtcaactcaggctcccgtcattacggcttccggaatgaccgccgacgaaatctgcagcgaagtggaaaaaaaatttcattaaaaagaaaaaaccgaagcttacgcttcggtttttctattcggcggaagcggcgtttttaaaacggtcgagcgcgattttcatttctctccgcagtacgcgttcaacccgccattgctccatattttctgttttggcaatgattctgatcaccatttctgacgagcttaaatcctgaaccccgatgacgtccggcccttccttaatctgcgggagctcagcggctgctttgtcacacgcggtttgcaggatttgaatggtttcatcaagatttttttcaagcggcactttaatatcgacaagcgcctgcatcgttccgcgggaatggttgctcacattcgtaatgccccggttgggaagatagtgaagcgtgccgtcaaagctccggatttgcgtcgtacggagaccgacctgctcgacaatgccgctgtagccggcaaccgtaatataatcaccgacgtcgatctgtttttccaaaaggataaaaaatccggtgacgatgtcactgacaagcccctgagccccgaagccgactgcgagaccgaccacgccggcgccggcaatgagagcgctcggattgtagtgaaataaatccaaaatcattacgataaaaacgaaaatcaggatgtatccatatacattaagcgcgaggcttcgcaaagtataagcgcggcctgtagagaggttgttttgttgctcgaatttctgaaacagatgcttgatcagcttttttcctgccgtccggaaaataaaatacgctaaaataatgagagccagctttatgatgaaaatcccggcagatgtgagaagcccggcccaatcaaagtgttttagatcaatcatagtgatgtcttcctttcaagtctattgcggaaaaagctaaaagtgatatacccgtttttaaaataaaataaaccttttaatagaaatcagttatttcatttatgatttgttcatattgcccggtttcaatatgatcatttttgtgaagatatgaactaaggaatcgccacactcattttaacatggtgattcagccaaatcatatcctttggagggaaaacaggataacgttgcccggcggactgaaagccccggcaaaaaacctttttcgtaaggagggaaataagatgaaattacgtcagcaaatgcctgaattgacaggcgctaaagcatggattaacagagaagtcacgaaggaacagctggtcggcggaaagccggcactgattcacttctggtccgccagctgccgcatgtgtaaagaagcgatgcctgaggtgaacgggtttcgtgataaatataaagatcagctgaatgtggtggccgttcacatgccccgttccgaagatgatcttgatcttgagaaaatcaagaaaacagcggctgaacatgatatctctcagccgatttacgtcgacagcgatcatacgctgactgaagcatttgaaaatgaatatgtgccggcttattacgtttttgataaaagcggacagctccgccattttcaagcgggaggaagcgggatgaaaatgcttgaaaaacgcgtcagccgagtactttcagaaacggagcaggcttctcagtaatcgggacaatctccgtcggactattgtctcggttccgcaaaccctttgccgtttaggtaacagggtttttttgtgcctattggataaaaaattccaatatgacatgtgtggcttaaaaaataagagaaacagccgtaaacacgctgtaccgcttgttttatccatatcattatcttttacatattatagtcgaaaattgtagatatcacgctaattttcattaaacaagtaatttcaagttatattttgaaatggttgaataaattggaactttgtccagaatcccctatatgataaggatttttgtatataaagtaccattttcagaaaataagcaatttttcatagagtaaataaaatagtaaaatgataaaataatagttgataaaattacttttgtaatctaatatcttaataaaagcgtttaaatttttgacagggggttttacacatgtttaatgaaagagaagcgctgcgcttacgtttagaacaattgaacgaagcagaggtaaaagtcattcgtgaatatcaaatagaacgtgataaaatatatgcaaaactgagagaattagacaatacaggcagcctgtccgatacaaaaaaagagtttcgtccggagaaaaaaagtgactctctcccggtgcttgcagagcttgcagcacaggaaatgagaagctatcaaaagccgcagacacagcctcaatcctcccagccgcagatgcagtctattacgtctcttcccgccggcattccggacggttctacaagaagaagaagagggacggcgagaccgggatcaaaagcggcaaaactgcgcgaagcagcgattaaaacgttgaaacgccacaatgcagcgatcaaaagttccgaactgcaaaaggaaattgaaaaggaaagcggccttgaaattcctaatatgacaacatttatgcaaagcttaattaaaatgtatccggaagtgaaaaaaccataccgcggccaatatattcttgagggagaaatttctcaggaaacagcagaaacggcaaatgatacggctgctgaataaaacagtaaaaactgcttgcgttactcaagcagtttttttgcgttttcccgcttattctgcggaagtgacgcatcttttcccggctttttttcaagcttgacgacatatttttggaaaggcttttcgccgtcagcacgttctttcaacgcatccagtttttcatcaaacgactgatcgcgggactctgattgtacaaattgtttttgcagggagatgacttgttcggtaacggctttaagcaagtcttctgcctgaacagtctctttggaaacagaagggatttccagagcttgttccgccggttccgccgtgcggctgtcaatatcagcaaaatggccggcaatccaagcatcactttcgtccagctgccgtttatacgaaagaatggtttcttgaaataacttttctttcgttttttctatttctacaagccgttcttttgtttctagtattcgatctctcatatgattaatttctattttaatatgtttgagctggtattctttttctatcatttgtgtttggagccgggtattttcgtctgcagcggcatgataacgctgtttcatatcttcgtgagaagtccgttcagtttgaatggcggtctcaagtgagcggatgcgggtatgtaagtttttattttcttcttcaaattttacatttgtaagatgcagacggtgcttttcttccatctcatttttccgccgaaacgtttcctgctgaagcagttcttgcagaatgacgattttatcgagcagcccggctctgatttcctgcaaagaacgttccgtgtcacttgtctgtttgtgtttttgagccatggcttccaattcgtcagaaagcttgtgaagccgctctttaatattggcgttttcctcctgaagcttattatttttctgatggaagtagcttgcttcaaattctgaaattaattttctgcatctggaaagttcggatttcaagtaaaggttctcttgagaagtgtcgtggaaaaacggaccggatattttcataagaaccatctccctcatgatgttaacactacaatatgggaaaggatcaacggctattcctcttaattaaacagacaagcaccgtaatattgtatttcggctgaggcgtttgctatgcttttatatagaatgggagagagatgacatgaaatgggtgaatgtaatattagcggggggagcttcccgaagattcggagaaccgaaagcttttgcaaagtggaagggcggcatgttttatgaacaggcgaaaaaagccttcggcggcggagaaacggtgattatcagccgccctgagcatataaaaaagttcttatcaaacagggagcggcatgtttttgccgatgagccgcggtttcggggaatgggcccgctggccggcatatatacggcaatgaaacaaacggaaggcgaaacatacacggtcatatcctgtgacacgccgctcgtgacaagaaagacgatggctgcacttgaaatgaagctgaccggaaatctggacgctgtcataccggtttgtgaaaacagagagcagcccctcttggcggtttaccataaacgggtgcagggtgtgctttttgatcagctgacacaaaacaaactgaaaatgacagacacgctgaaacggctgtctgtctgttatgtgcaggctgaagacatcggcgccgggccggaggagttcgctaatatcaacacacgggacgattacaccagacttttggcgcatgtcgagtcttcaaatcaggactgatcgggaagaaacatggtatgatggaaataaaaatgcaaggggacaacacagatggaagagcgctattcgcggcagacaagatttaagccgataggggaaaaagggcagcaggcgctggctgacagcagtgtcctgattgtcggagccggagccctcggaacagccgcggcagagggcctggcaagagccggagcgggccgtatgacgattattgaccgggattatgtggaatggagcaatttacaaagacagcagctgtatacagaagaagacgcgagacagcgcctgccgaaagcaatggcggccaaggcgcgtcttttggcggtaaacagtgatatacatatcgatgcttacgcggcggaaggtacggcggaaacgctcgaaccgctgatcgaacaagcggattgcatcgtggatgcgacagataattttgaaacgagaatggtcatcaatgatctggcgctgaaaacggaaacaccttggatttacggtgcctgtgtcagcagtcagggaatgtgcatgacgattattccgggggttacgccgtgtttatcctgcctgtttgagcaaatgcccgtgggcggagcgacatgtgatacagcaggtatcatacctccggcggttcatatcgtctccgcttatcagcaggctgaggcgctgaaattgctgacaggaaatcatgcggcggtaaatcggcgctttttcacgtttgacgtgtggaataacaccaatatgagcataaatgtggatcagatcaaacgggatcattgcccttcctgcggcgcggcgcccgtatatccgtatctgcagcctgaaaacaggccgaaagcaagcgtgctgtgcggaagagacaccgttcaaatcagatcggaagccttaaagaggctggataaagaagagcttgtcaaacgtctgaagcagatcggtaaagtggaagcaaatgaatttctgctgcacatggcgtatgagcgcttcagaatcgttatttttcaggatggccgggctctgattcacggtacaaacgatataaaagaagcaaattcagttctggccagggtgatcggactgtaggaaggggagatattgctatgcttgaaaaaagaacgccgattcaggtggacgaagcagtccgccgggtgagccggtataaaaaacagggggataccgaatgggtggcgcttgaggacagtctccaccgctatttggtggaggatcttaaggcggatcatgatgtgccggcctttaaccgttccccgtatgacgggtttgccatcagggcgagcgattcaaaaacggcttcccgtgacaatgccgtcacctttgaagtcattgaccatatcggagccggcgccgtgtcagaaaaagaactcgggccttatgaagcggtccgcattatgacgggggcgcagattccaaaaggcgcggatgccgtagtgatgcttgagctgacaaaaacgttttctgaaaacgggacgaattacatgtcagtgaaacgcccttttcatgcgggcgataatatttcatatcaaggagaagatgcgaaaaagggcagctcgctattaaaaaaagggacgaaaatcacgccgggcgtaaccgctcttttagcaaccttcggctatgcttccgttcccgtggtcagaaagccggttgtcggcattatcgcaacgggaaccgagcttcttcatgtcagcgatccgcttgagccggggaaaatccgcaacagcaacgctgccatggtgtatgcccaggtcattgaagcgggcgcggtaccgctgaacttagggaaaatttccgatgattttgatgacagctatgctgcggtgaaggaagctatgaaaaaagttgattttctgatcacgaccggcggcgtgtcagtcggcgattttgattttcttccagacatttataataagctcggagcggaagttctttttaacaaagtggcaatgcgcccggggagcgtgacaactgtcgcccgggccgatgacatgctgctgttcggcctttcaggcaatccgtccgcatgttatgtcggattcaccctgtttgtcaaaccgatgattcagacgtggcttctgaatgaaaaacctcattccggatgggcggaagccgtgttaacaaacgactttccgaagccgaatccgtttacgagatttgtgagggcgtttgtttatcataaggacggaaagatgatggcgtcaccggtcggtctcgacaaatcaagttcagtcacatctctagccgaagcaaacgcgtttatccttctgccgggaggaacgagggggtatgaagcgggccggacggttcacgtgctcctcatccgtgatgagaatggaagtgaatggccgtggtcaattctttcccgatcgtccagatcgtaggttttcaaaacagcggtaaaacaacgtttattgaacgtgtgctgaaagcggcgccgaaagagtgcgatattggatgtttaaaacatcacggacatggcggagaaccggaacctttttctgacggaaaagactcggagcgtttttcaaaagccggagccgcggttacggcagtagaaggggacggcgtcctgcagcttacggcgcgaaaaaaatgggatctggcgggtttgatcagtctgtatgaatgtctgggaattgacggtcttctcatagagggatttaaatatgcgccgcatccgaaaatcattatgatcaaagacagcgaagattggcaaaagctgaagcatttggagcgcgtgatcgcggttgtcagcagaaatacggagcatatgccggcagatgcaggcatgcccgtattccatgcggatgatccggctgccattatgtttgtgctttcgcagctgaaaggggaatctgcataaatggaacgttttcaaattacaagggaacctatcattgcggaaaatatcgtaaaaaaagttgaaaagcgtgaagccggcgccatcacaacgtttatcggcacggtcagagagtggactgcaggacggcggacggtgcgtctcgaatatgaagcgtatgaaccgatggctgttcaaatgctttctcaaatcggcgatgaaatcagtgcgaaatgggaaggagccgaagctgcaatcactcaccgtgtcggcgtccttgatatcggagaagcagcggtcgtaatcgccgtgtcttcaccgcacagaaaggcggcatatgaggcgaatgaatatgcaattgaacggataaaacagattgtgccgatatggaaaaaagaaatctgggaagacggcgaagaatggataggcgatcagctggaaacaacgccctatccgaacggaaaaccggatttggataaaggggaatcgcgatgattaaagtactattgtttgccgggcttgcggagcaggcgggaacaccggtcattgaacttgacgaaaaagagacggcggcgtctgctgtaaaaacactgttaaaggaacggtacggacttcagacgattgacaatgccatgatcgcaatcaatgaaacatatgtaaaagacaacagcatcgtaacagaaggtgatactattgcctttatccctcctgtaagcggagggtgaaaaaagagccggatgtgcatcattgccatccggcttttttatatataggagctgaattacagagaatatctaaatgggatttaaagggatttgtgattgagacggttttgattagatgaataggctgaagacagtgccttcacaaggctttgagcctcccgtcataccggtctgacaatacttttttttacataattatggaacgtaaagctaagaatttgtgttacaatttagcataaatacgcaaacggcaaaaaaattgaaacttctctcagcctaaagcgtacgtataaacagaataatacataggaggcatcagcaatatggaaccaaacctggaaaaaagcaatacggcagtaacggaaaagccgtcaattttcggcgtcattacaagtcctgttgtgcagtttaaaagattaaaagaaaagccggtcatcggcattcctctcctgattgtcatcattctcatcgcggccggcagtattttgcgcggactggggatgaattatgaagaagtgctgaacagcacatctcttgacggattgtcggatgatcagattgaaatgaccaaaaccattgctaaattcggctcgatgttcggaggaatcttcgggggcattatcgctctgtttatcgttccgctcatttactggctgtgcgtcaaaatttcaggcggcgtgacaacttacaaaaaaatgctctcactcagcctgtttacggcattcattaccaatatcggcttagtcattaacggtcttgtcacttattttaccggtgcgggctcactgtacgccgttacatctttggcgagtgtcataccggccggagacggcgtcgcggtctttttaagcgcgttcgacattttcagcatctggagctatattctgctcgctttgggacttcgctatacaggcggcatttcaaaaaaagcggcctggacttccgcgattgtcctgtttgttattatgcttatggtttcggcagtcggaggactgttaagttcagtgacagcaggtgtataacatgaaaaaaatttatatcggaatcggcatcgccgtaattgttgcagtattcatcggtatcaatatttataagtctgccgctcccgcgggcggcagcgccgggaaaaaaatcgaaaccggaaccatggaaaacagagaaatctcctctacggttatggttccgggaacacttaaattctctaaagaacagtatgttttttatgaagcggataaaggaactcttgataaagtgaaagtaaaagaaggcgacaaagtaaaaaaagggtcgtcgttagtcacgtatacaaatgagcagctcaatcttgataaagaacaaaatgagttgacagaacaatcaaaacggatgcaaatcgaacaagttgaagaaaaactcagagcattaaacagcaaggaacaagatctggcaaaacaagtgggagaagctgaagccaaaaaacaaattgaatccgaacggactgatctgcagcttcagcaaaaaacggcggaaatcgaattaaagcaatctgatttgcaaaagcagtctcttgaaaatcaagtggcgaatctcaatgttaagagtgagatggacgggacggttatctcggtaaatcaagaagcggcttctaaaaaatcggatattcaagaaccggttatacatataggagacccggaacacctgatcgttgccggcaatttgtccgaatacgatacgctgaaagtgaaaaagggccaaagtgttacgattacctcagacgccatccccggtaaaacgtggaaagggagagtggcggctgtcggactcgttcctgatcaaaagtcaagcgctgcttcgggggaaagcgcggaacaggccgtgcagtatccgtttcaggttaagctgatcggaaaccttccggagggcaagccggggtttaaattaattatgaacattgaaaccgacaaacggaaagccgatacgctgccgtcctccgcggtcaaaaaagacggagatgagcactgggtctttacggtaaaagacgggaaggccaaacgcgtgaaagttaaagtcggcgataccgcaaatcagcttacggagataaaagaggggctttcaaaggatgataaagtcattctgaatccggctgacgatttgactgacggaacggatgtgaaagcatagatgattcagctttcaaaggtgaaaaaaagttatcagatcggcaaggagacgtttgatgttcttcgttcaatcgacctgacgattgaagaaggagaatatgtgtcaattatgggaccgtcgggatcgggaaaatctacgatcatgaatatcatcggctgtctggacagaccgacgtccggcagttacaggcttgcgggcgaagatgtttcttcatgtaccgaaaaagagcttgcggcggtccggaacaaatcaatcggatttgtctttcagcaatttcagctgctgccgcgattgaatgcaagaaaaaatgtcgaactccccatgatctacgccggtatcggcaaaaaagagcgtgaggaacgggctgagcatgcgctggaaaaagtcggtttggcggatcggatgcgtcacatgccgaatgagctgtcaggcggccagaagcagcgtgtcgcgattgcaagagccatcgtgaacgaaccgaagctcattttagctgatgaaccgaccggcgcgctggatacgaaaacaagcatttctattatggagcagttcacagagcttaatgcagagggcgtgaccgtggtgcttgtgactcatgagcctgaagtggcggactgtacaaacagagtgattttcgtccgtgacggcatgatcgtttcccgcgatgctgagcagaggagagtgggggaatgagcctgttagaaaatctccggatggccctcagttccgtaagagctcacaagctgagatcgatcctgacaatgctcggaatcattatcggcgtcggttcagtaatcgtggttgtggctgtcggccagggcggagagcaaatgctgaagcaatccatcagcgggccgggcaatacgattgaattgttttaccttccgagtgatgaagaattaacagccaatccgaacgccttacaggaagcgagttttacagaagaagatattaatggattaaaaggagtggacggcgtaaagcaggttgtcgcttccgcggtaaaatccatgacggcccgttaccatgaagaagacacggatattacgctgaacggcattaacagcggctacatggacgtaaaaaagctggacgttcaagatggacggacatttacggacaatgattttctttccgggaaaagagcgggaatcatctcgaaaaaaatggctgaaaagctgttcgggaaaacgtctccgctcggaaaaatcgtctgggccggcggacagcccgttgaagtaatcggcgtactgaaagaagagagcggttttttatcgttaggactcagtgaaatgtatgtgccgttcaacatgctgaaaacgtctttcggtactaacgactacagcaacgtttccgttcagacggagtccgctgatcaaatcaaaacaacaggaaaagaagcggcccgtctcttaaatgacaatcacggtacaaaagaggcctatcaagtcatgaatatggaagaaatcgcggcgggaatcggtcaggtcacgaccgtcatgacgacgatcatcggttcgatcgccggtatttctctcattgtcggcgggatcggggtcatgaatattatgctcgtatcagtgacggaacggacaagagaaatcggcatccgcaaatcgctcggtgccacgagaggacagattctgacacaattcttaattgaatctgttgtgcttacattaatcggcggcttaatcggaatcggtctcggctacgggggagcatcactcgtttctcttatcgcaggctggccgtcgctcgtttcctggcaggtggtttgtatcggcgtactgttcagtatgctgatcggtgtcattttcggcatgctgcccgccaacaaagcatcacgcttagatccgattgaagcgttaaggtatgaataacctgcgccccatgcagtctgcatggggttttttgtgttttaatgattgaatgaatataatagacttttttcatttatgataaaaagaaaatgtcatacaattgtccccctttttgtcgaatttacagtttacaaaccctatgtacatacgttaatatgaacaaatgtgaaagattttgatagttattgaatgaatttgagtgattttagttgcttgaagtaaaaaaagcgtttacaattatcttgcagccgaaatgaatacgttttcaaaggaggcggaatatgctcactcctgaaaggtatcagctgattatggatcagattgaaaagcgagatgtggtgaagattcaagagctgataagcatgacaaacgcttctgaatcaacgatcagaagagatttatcaacacttgaagagcgcgggtttttaaagcgcgttcacggcggggcgtctaaactttccaacagcaggcaagaacccgatatgcttgaaaaatcctccaaaaaccttcaggataaactgaagatcgctgaagaagcggcatctttattagaagaaggtgactgtatttaccttgatgcgggaacaactacattgcacatgattgattttatagatcatacaaaggacattgtggttgtcacaaacggggttatgcatatcgacgctttaataaggaaagggattcctttttatcttctcggaggatatgtgaagcatagaacaggtgcgatgatcggcggcgcctcattaacggcggtcagccagtaccgttttgacaaaagctttctcggggtgaacggcgtgcacattgaagccggctttacaacacccgatccggatgaggctcttctgaagacaaaggctgtgagacaggcgaaaaatgcgtatgttttagccgatccttctaaattcggcgagatttctttcgcagcgttcgccgccttgggcgatgcagctatcattaccactgaagctgaagaacttgcattcgataattaccaagaaaaaactgtcgtaaaggtagtgaaaccatgatttacactgtaaccctcaatccgtctgttgactatatcgttcacgttgaagattttgccgtaggcggtttaaaccgttcaagctatgacacgaagtatcccggcggaaaaggcatcaacgtttcgagattactgaaaagacaccatgtgccgtcaaaagcattggggtttgtcggcggatttaccggaaattatatcacgtcatttttgcagcaggaaggtctggaaacggctttttctgaggtagatgaagacacgcgtataaatgtaaaactgaaaacgggcgatgaaacggaaattaacggacagggcccgacgatttcagacgaagtgttcaatgcctttttagaacagttctccgctctggaagagggagacatcgtcgttttagcgggaagcattccttcttccctgccgcataacacgtatgaaaaaattgctgaggcatgcagaaagcagaatgcccgggtagtggtggacatctccggtgaagcgctgatgaaagcgacagaaatgaaaccgtttttgatgaagccgaatcatcatgagcttggggaaatgtttaatacggtcattgattcagccgaagctgccgttccttacggtaaaaaattaattgaacaaggcgctgaacacgcgattgtttcgatggctggcgacggtgcgcttttatttacgaaagaggcggttttcctcgccaatgttcctaaaggaaagcttgtcaattccgtaggcgcgggtgattccgtcgtcgcgggattccttgcgggaatttcaaaacagctgcctttggaagatgcgttccgtttaggagttgcttccggaagcgcgacggcattttctgaagaactcggaactgaagagtttgtacagcagcttcttcctgaagttaaagtcacacgtctatagaggaggaaagaaaagtgaagataactgagctgttaacaagagatacaattcatctcaatatagaaagcaaagagaaagaaaacgttatcgatgaaatggtgacagtgcttgacaaagccggcagattaaatgacagagaggcttacaaagcagccattttaaatcgtgaaagccaaagctcgacgggaatcggcgaaggcattgccattcctcatgcgaagacggcgagcgtcattaacccggccatcgcattcggccgttcaaaagatggtgtggattatgaatcattagacggtcagccggcacacctggtctttatgattgcggcaaccgaaggagcgaataatacgcaccttgaggcattatcaagactttcaacgcttcttatgcgtgaggaaatccgcaaacagcttcttgaagctgaatcagaagacgcgatcattgacatcatcaatcagcatgacaaagatgacgatgaggaagaagaagagcaggaagaacaggcagcgccgtcaggaaaaggcaaaatccttgccgttacggcatgtccgacaggtatcgcccatacgttcatggcagctgacgcactgaaggaaaaagcgaaagagctcggcgttgacattaaagtcgagacaaacggctcaagcggtatcaaacataagctgacggctcaagaaattgaagacgcgcctgcgatcatcgtggcggctgataaacaggttgaaatggaacgctttaaaggcaaacatgttcttcaagtacctgtaacagctggtatcagacgtcctcaggaactgattgaaaaagccgttaaccaagatgcgccgatttacgagggcagcggcggaggatcttccgcttcagatgaagacggcccgaaacagaaatcaggaacaagcatcggaagcactttctataaacacttaatgagcggtgtcagcaacatgctgccatttgtcgtcggcggcggaattctcgttgcgatctcattcttctggggcattcattcagctgatccgaaagacccgacatacaacacgtttgccgcagcgctgaactttatcggcagcgataatgcgttaaaactgatcgttgcagttcttgccggattcattgcaatgagtattgcggaccgtccgggatttgcgccgggtatggtcggcggatttatggctacgcaggcgaatgccggattcttgggcggactgattgccggattcttagccggttatgtcgtaatcctgctgaaaaagctgtttgtctttatccctcaatctcttgacggattaaaacctgtactgatttatccgctgctcggtatttttatcacaggagttctgatgcaatttgtcataaacactcctgtagcagcgttcatgaatttcttaacaaattggcttgaaagccttggaactggaaaccttgtcttaatgggtattattttaggcggtatgatggctatcgacatgggcggcccgctcaataaagcggccttcactttcggtatcgcgatgatcgatgccggaaactatgcgccgcatgcggccatcatggcgggcggaatggctccgccgcttggaatcgcactggcgacaacattctttaaacacaaattctctaaacgtgaccgtgaagccggtattacgtgctacttcatgggagcagctttcgttacagaaggcgccatcccgtttgcagcggctgatccgcttcgcgtcatccctgcagccgttgtcggttctgcggtagcgggcgggttgacagagtttttccgggtaacgcttcctgcaccgcacggaggaatattcgttgcattcattacgaaccatccgctgctttacttaatgagtatcgtgatcggagcgattgtaacggcggttatcttgggaatcgtcaaaaaaccggttgtagagaaataagcaaaaagcgtcctttacgggcgcttttttcaatcatgtgcgcatagaagcgttatgtattttatgatgagttatgataaagtaaagatggtacatgaaccgaaacagtgatcgtctaggaggaaccacgttgactgaagaacaaaaacctacttctgaaaaatcggtaaaaagaaaatccaacacatattgggaatggggaaaggccatcattatagcggtcgcacttgcgctgttaatccgccatttcctgtttgaaccgtacttagtggaaggatcatcaatgtacccgacattacatgacggtgaaaggctgtttgtcaacaaaagcgtcaattatatcggagaaatcgagcggggggacatcgtcattattaacggcgatacatcgaaagtccattatgtaaagcggctcatcggaaaaccgggagaaacggtggaaatgaaaaatgacacgctttatataaacggcaaaaaaatcgcagaaccgtacctcgcgagcaataaaaaagaagcgaaaaaactgggagtcaacctgacgggagatttcggccccgtaaaggttccgaaaggcaaatacttcgtcatgggtgacaatcggctgaactcaatggacagccggaacggactcggtttaattgccgaaaaccggatcgtcggcacctcgaagtttgtgttcttcccgtttcatgatatgcgtcagacaaaataaaaacgccgcgctgcccgatttggacagcaggcgttttttatttggcaaacgaggcggcgacggcaatgaacaataccgtggccagcactgatccgacaatggccagaacgctgaaaaaaagattcacctgcttcttctctttgccgcgtttttcaagcatccgttttgaaaagagatgcgaaaacgtataaatgagggcgattccgatgtacaagccgatgtcacgggccgtaaagcctgtgacggccagaaaaaccccggtgaagaaaatcataagacagtattctgtgagtgttaaaagcttcaacttgttcctccgtgatgaatatgtatatatatctattgtatcacagcgctccgggtttgacgcctgcatcttttcaaacccgtatattcgcagggaaacatttctcttcccctttattcatggtatacttttaatgatgatagacacgatggaggattctaaatgattgctgtaaataatgtgagcttgcgttttgcggatcgcaagttatttgaagatgtcaatattaaatttacgccgggcaactgctacggattaataggcgcaaacggtgccggaaaatcaacatttttgaaaattttatccggtgagctggagccgcagaccggcgatgtccatatgagcccgggtgaacgtcttgccattctgaagcagaaccactttgaatatgaagacttcgaagtgctgaaagtcgtcattatgggacataaacgtttatacgaagttatgcaggaaaaagacgcgatttatatgaagcctgatttttcagatgaagacggcatccgcgccgctgagcttgaaggagagtttgcggaattaaacggatgggaagctgaaagtgaagccgctattttgttaaagggcctgggcatctctgaagacctgcatacgaagaaaatggcggacttaggcggttcagaaaaggtgaaagtgcttttggcacaggcgctgttcggcaagccggacgttctgctgcttgatgaaccgaccaaccacttggatctgaaagcgattcagtggctggaagagtttttaatcaactttgagaacacagtcatcgtcgtatcccatgaccgtcactttttaaataaagtgtgcacgcacatcgccgatcttgattttaataaaattcaagtgtacgtcggcaactatgatttctggtatgaatccagccagcttgctttaaagctttctcaggaagccaacaagaaaaaagaagagcagattaaacagcttcaggagttcgtggccagattcagcgccaacgcttctaaatcaaagcaggcgacatcaagaaagaaactccttgataaaatcacgcttgatgatatcaaaccgtcatcacgccgttatccttatgtcaatttcacgccggaacgcgagatcggaaatgacgtgctgcgggttgaaggcttaacaaaaacgattgacggggtaaaagtgcttgataacgtcagctttattatgaacagagaagataaaatcgcttttacgggccgcaacgaacttgccgttacgacattgtttaaaatcatttccggggaaatggaagctgacagcggcacatttaaatggggcgtgaccacttctcaggcgtacttccctaaagacaacagcgagtattttgacggcagcgatgtgaaccttgttgactggctccgccaatactcgccgcatgaccaaagcgaaagctttctgcgcggtttcttaggacgcatgctgttctcaggagaagaagtcaacaaaaaatcaaacgttctttccggaggagaaaaagtgcgctgcatgctttcaaaagcgatgctttccggcgcgaatattttaattctggatgaaccgacaaaccacttagatttggaatccattacggcgcttaacaacggcttaatcagctttaaaggcgctatgctgttttcatctcatgaccatcagtttgtacagacaattgccaaccgcatcattgaattaacgcctaaaggcattgttgacaaacaaatgtcttatgacgaatttcttgaaaacgcggatgtacagaaaaagcttgaagagctatacgcgtaataaagaagcaggggagactctgcttttttatttatgaaaaaagttttcaatcttctgacttcccgttacaataaatgaatacataacttgaaaagagacggaggaatgcatcatgaagtttttaattgtcggagctggaggagtgggcggatatatcggcgcgcgtcttgcagaaaagggaaatgacgttacgtttctcgtccgcaagaaacgggcggaacaattacaagaaacgggtttgatcgtcaaaagtgcaaaaggtgatgtttcaatcaagccgaaattaatgatggcgggcgaagaaggagcatttgacgccgttattatcgcttcaaaagcgtattctttgcaggacgttattcgggatgtcaaaccgtttgtcaaaccttcgtcggtcattattccttttttaaacggatacaggcactataaccagctgtttgaagctttttcaaaacggcaggtgctgggcggcctctgctttattgagagcgcccttaacgacaaaggggacattcttcatacgagcgctgcccaccgctttgttttcggtgaatggaacggggaacgcacagaacgtatgaacgagctggaaaacgcatttgcaggtgtgaaagcggatgtcatcatcagccgggatattgaaaaggacatttggaaaaaatatatgtttattgccgcgcaggcgggagtgaccactctgtttcaacagccggtcggaccgattttagaaacagaaggcggccgcaacacggcaaagcgcctctttgctgaaatcggagccattttcaaggctgccggcatcccgaaagatcctggtctggaagaagagagttatcgcacattgacaagcatgtcttaccatatgaaatcgtcgatgctgagagatatggaaaagggcagggtgacggaaggtgatcatttacacggatttttgcttgagaaagcgaaaggcttgtcagttgatacacctgttttggaaaccgtctgcgccaacttgcaaatgtatgaagcgaaataaaaaaaggaggcctgatcgcctccttttttattaaaatgcccagtttccgtttctgaagatcggttctcttttgccgtccgccgtaatgccgtcgatattcatatctttggaaccgaccataaaatctacgtgtgtaatgctttcatttaagccctctttgacaagctcttcccgtgtcatttgtttgccgccctcaatattaaaggcatacgcactgccgatcgccaagtggttagaggcgttttcatcgtacagtgtgttgtaaaataaaatatttgattgtgaaatcggtgaatcgtacggcactaaggccacttctccgagatagtgtgagccttcatcggtttcgacgatgccttttaaaatctcctcgcctttttcagctttcacatcgacaatgcggccgttttcaaaggtaagagtgaagttatcaataatgttgccgccgtagctcagcggtttcgtgctggaaaccgtgccgttcaccccgtcacgctgcgggagggtgaaaacctcttctgtcggcatgttggccatgaattcgtgcccgctctcattcacgcttcccgcgcctgcccatacatgttttttcggcagttcaatggttaagtctgttccttcagcctgataatgcagggcgctgtaatgttttttgttcaggtgttccactttttcatgaagattttgatcatgttttttccatgcttccacagggttttcttcatttactcgggtcgttttgaaaatttcttcccataaaagctgaacggctgtttcttccggctgatccgggaacacttttttcgcccagcctgttgaagccgctccgatcaccgtccagctgaccttatctgattgaatatattgtctgtatgtatgcaatgcttttccggcggctttttggaacgctgcaatccgtttgccgtcagtgccttttaacaggtcggggtcggatgagacaacagaaataaacgcagccccttttttcgcgagctcttcttttccttttgcttcccattcaggatactcttcaaacgcttcaaacggtgccatctcgtattttaatctggacagttcatcgtcctgccaatttacggtgacgttttttgcgcctttttcataagaatgtttggcaagcagtctgactagttcccgaacatcagttgaggcattgattacgacatgctgtcctttttggacattgacgccgacttctaccgccagctgagcatatgtatgtaacttttcagtaaacgaactcatcgttcattcctcctcatcggtttttctcatcatatcaaatatcgcctcataaaggaaagaaaggagcacaaacgaaaaagacacagcttttgctgcgtctttacgggtgattcagttttacggcgccgccggccggagaatggggcatattggccagtgaaatgctcataccccccaaaataattccgcttaaaatgacggctactgctacgcgtcttcccacatctctaagcatatgcttcctccttaatgtttctccagttctcacaatatgagccggccggagaaaaaagaagcacaatcttattatttaatcgctttttgcagcttgtcgatgacgtctaatgaacgccccgtgccgatagccactgattcaagcggatttgccgccaaatgaacgggaacgacgatttcttctgtcagccattctttcatcccgtttaaaagggagcctccgcctgttaacacgacgccgcggtcaacaatatcaccgctgagctccggcgggcaatcttcaagtgtcgctctgatcgcttcaagaatatgtaagagcgactcacgcatcgcgtgctgaatttcattagactgcagtctgattgtcttcggcagaccggttacaaggtcacggccgcggatttccatcgtttccggcacatgttcaatcaatgcaaaaccgatttccattttcacttgttctgccgtacgttccccgatcagcaggttgtatttttttctgacgaacgaggcgatatcttcatcaagctggtcgccgccgattctgatcgaatggcaggatacgacgcccccgaatgagataatggcgacttcagtcgtaccgccgccgatatctacgacgacgtttgcgaccggctcgtcaacagggaggtcggccccgattgcagcggctacgggttcttcaatcaagtgaacgtttttcgctccgcagtttttgacagcgtcactgatggcgcggcgttcaacggctgttgagcctgaaggcgtgcagacgacgacattcggtttgcggaaagtcattccgattttttttccggcttttttcataatgtgttttaataagtcagttgtcatatcataatcagcaatgacaccgtctttcatcggccgtacggcgacgattttccccggcgtctttccgatcatgcttttggcatccgttccgatggcaagcaccgctttcgttgttgtatctacagcgacaacggaaggttcgtttaaaataattcctttatttttactgtaaacaagtatattagcggttcctaagtcgattccgatctcagttgattgaaacatgttttcacccaatccctatcctgatttaattgattctacatttaaagtttctgagaaaaaccacgatttttgggggtttccgccgggaatgaaatgtttttgtaaaaaaggagggaaagtctgtatcctatatttcaaaaggattttcttttgtaaaaaaacattcagttccggatgctgagaaacttttgctccgttcctttcgtctacgtttatgaaggattttccttggacataaagaagagacattaaaggaagtaggggatttctatgaaatcaattggtgtagtaagaaaagtagacgaactcgggcgtattgtcatgccgattgaattgagaagagcattggatatcgctattaaagatagtattgaatttttcgttgacggagacaaaattgtcttaaaaaaatacaagccgcacggcatttgcttaatgacgggggaaattacctccgaaaatcaggagtacggcaacggcaaaattattttaagtcctgaaggagcgaaaatgctgcttgaggaaatcgaggaagcgttaaaaggtagatcataatcggcaaaaagggcggagcatcattccgtccttttattatgaacttgtgcaaaaactcacgggaaaagtaagcgaacctgctcaattaattgggaatagttatcattttttagtcaataatgcagtcaacaatgttacaatatatgtagaaatgctagcggcaggtgggactatgggaaaatatcaagcgcgtatcatttccttaatcttggcaatgatttttattatgttttgggattatttattttatatgattgaacggaatccgattaactggccagttgacatcacctttaccgccgtcacattaatcggcgtctggctgctggcttattatgtggacaataaaaagcagctgctggcggagctgaaggacagcgagcagaaagcaaaggcgctttcagatgagaaaaaccggatcatggacaatctgcaggaaatcgtttttcagacggatgcacaagggaatattacatatttgaatcaggcctggacggcgattacgggccactccatcagcgaatgtatgggcacgatgtataatgattattttataaaagaaaaacatatcattgattatattatctcccaaatcaagcagcagtccccgtcaggaatgtttacggccaaatatattaaaagagacggctcgatcttttggggagaagtccattataagctgtattatgaccgcagacagaaatttgtcggaagcctggggacgatgtctgatatcagtgaacggaaaaaagcggtcgacgagcttctggaaacgaacgaacgccttgccatgcaatctcaaaagctggccattgccggggagcttgcggcaggaatcgcccatgaagtaagaaatcctttaacgtcagtcagcggctttctccagctgatgaaagcccagtatccggaaagaacggattattttgatattattttttcggagattaaaaggattgatctcgtgctgggggagctgcttctgctcgccaagccgcagaccgtgacgtttaccgctcatcatctcaaccatattttaaggcaggtggcgacgcttcttgacacgaacgcggtgctgtcgaacactgtgattgagaaggatttcaggcagactgagtcctgtatggtcaacggtgacgaaaaccagctgaaacaggtatttatcaatattattaaaaatgcgattgaagcgatgcctgacggcgggaatattcatatttatacaaagcgggatgaagaatacgcggtgatcagcatacaggatgaagggaacggtatgtcgaaagaaaagcttgaaaacatcgggaaaccgtttttctcaacaaaagatcagggaacgggtctcggtcttccgatttgtttacgaattctgaaggagcataatggtaaacttaacattaagagcaaaaatggagaaggcagtacgtttcaggtgattctgccgttagaagcggctgctgtccaaaaggaggaaaaataacttgcttctttttgtatacggtttgttacggaagcgtgaagaaaaccatgaactgttgaaaggcgctccgtgtgtgtgtgagcaggccgcgataaacggcgtgctgtacgaaacggataaaggtcagcctgcggcgtctttagcagaaacagcttttgtgtacggggaattgtatgaaacagatcatcagatgatccgtaagctggatgcgtattatgctgattttgatcggaaagaggttgccgtgacgacggatgccgggaataaaaccgccttcgcatatgtcgtaaagcccggccagtgtgcctcattcagccgtatcaaaagcggagactggaaagaataccgttttatgaaacgggaggatgacagtccggtttattatttcgcttacggctcctgtatggacaatgcccggtttaaacaggcgggggtcgaccacttttttgccgagccggtcggaggggcggttgttgaagggtattcgacgagattcacgttaaggcgtcctgacggttccagagccgatcttgttgaagacggggggcgaactgaaggcgtgctgtacaagctcccgtttgaagcggcaacctatctgtacaaaagagaaggtgttgataaccacacataccgtcccgcgttcatagaagtgtgtgccggcggccgtgtatacagaggcgtcctgacgtttctcgttcttgataaagctgaggaaattgcgcctccgggtcactatcaggaagaaatcgaacgcggagcggacctgtatttatcgcccgccttttcagaaaagcttaaacgctatatgaactcattgccgaaaatgtgatactattcctattagagatattgtttaaaggagtactgttatgagaaaagagtttgccgttatcggtctcggacgcttcggcggaagtatttgcaaagcattaagtgaagaaggccttgaggtcatggcgatggatattgatgaagataaagtgaatgaatacgccaaaatcgcatcacacgcggtcatcggcgattcaaccgatgaatcggtgctgaaaaacttagggctgcgcaactttgaccatgtcattgtggcaatcggcgaaaatatacaggcgagcattttaacgacgctgatcttaaaggaactcggcgtgaacacgatcacggtaaaagcgcagaacgattatcatgagaaagtgcttgcgaaaatcggcgccgaccacatcgtccaccctgaacgtgacatggcaaaacgcatcgcccacaacatcgtatcaaataatgtacttgattatttggagctgtccgacgaacacagcattgtggagatcgtggccaacagcaggcttgcgggcaacacactgcttgatctggacatccgggcgaagtacggcattaatatcgtggccatcaagagagaaaaagaagtgatcgtatctccgctggcgactgaaatgatccaaaaagaagatattctcatcgttatcggctctcttacggacatttcccgatttgaaaaaagagtgcttcatacaaagtgaaaagccgtccgtaaaaggacggtcttttattatgtcagaatagtaagacatttatcgtgtaagcggtattttctgcgatttttattgactatgatcaagcgatccgatagcatattgtaccatataaagaaaaagaggaggcctcattttgaacaaagaaacactggctgaacggctgaatgcatcagccggcagacaaaaagccgataccgtcattaaaaacggaaaaatcatggatgtatttaaccaggaatggatttctgcagatatcgccattacgggcggagtgatcgtcgggctgggcgaatatgaaggggaagaagttattgatgcagaaggccaaatgatcgttccgggctttattgacggacatgttcatatcgagtcctctatggttactccgattgaatttgctaaagccgtcctcccacacggagtgactactgtcgttactgatcctcacgaaattgcgaacgtttccggagcaaaaggcatttcttttatgatagagcaggcgaaaaaggcgccgctgaacatccgtttcatgcttccttcctgtgttcccgccgctagctttgaacgctcaggagccgtattaaaagccgaggatttaaagcctttttatcaggagaaagaggtgctcggacttgcggaagtaatggattatgtgtctgttgcggaaggtgaagaggatatgcttcagaaactgcttgatgccaagcgtcacggaaaacggatcgacgggcatttagccggactctcttcagatatcatcaatatatatagaaccgcaatggtgtcaaatgatcatgaagtgacgacaaaagaagaagcgctggacagaatcagacggggaatgtatgtcatgctgcgcgaaggatcggtggcaaaaaatacgctcaatgtgctgccggcggtgaatgaaaaaaacgcgcggcgctttttcttttgcacggatgataagcatgtagatgatctgctttcagaaggaagtgtgaaccaccaagtcaaaatggcgataaaggcgggacttgatccattccttgcgtatcagctcgccagcttaaatgcggctgagtgctacggtcttgaaacaaaaggggcggtagcgccgggttttgacgcagatctgctgttcatttcagatgtacgggaggctgccgtcacgaagaccatggtcgccggccggaccgttgccgagaacggacgcacggtttatgaacagtctgccggttcctattcgccggaccaggcgctgttggatacagtgcggctgaaagcgccgctgactgaatcggattttcatataccgattcaagagggcaagaaaatgaatgtaatcgaaatgataccgaatcatttggagacgagaaaaaaagaagtgcctgcaccgtctgctgacgcgtttcgtcctgatacagaaaatgatttattaaaaatcgccgtcgcagagcggcacagcggcgaaaaaatgataggactcgggattgtacaagggttcgggttaaaagaaggcgccatcgccacaaccatttctcacgattcccataatatcatcgccgtcggtacaaacgatgccgatttggcaaaagcaatcaacaggctccgtgacaccggaggaggattaacagccgtgaaaaacggagaattgcttcactccgttccgcttccgatcgccgggcttttgtctgataagtcggcggaatgggtcaatgacagcttgggcgtgcttcatgaaaagcttccgctgctcggattcaccggtgatttcaatccgtttctcacattatcgtttttagcgcttccggtgattccggatattaaaatgacagcagccggtctgtttgatgtcaaagcctttcagcatattccgctgcaataaaaaaactgcactcgtaatgagtgcagtttttttagacctccataatgatcggaaggatcatcgggcggcgttttgttttttcgtataggaacggagcaagcgtatcggtaatttcgtttttaatttcggaccactgcgttgttttccgatccattactttctccagatggttcgaaatgagctgctgcgcgtcattgatcaaatcaccggattctctcatgtatacaaaacctcttgagattaaatcaggtcccgctgaaaccttaaagtcgtccatattgatgctgacaacaacgataacaaggccttcttctgaaagaatgcggcggtcgcggagcacgatattgccgatatcaccgattccgcttccgtcaatgtaaacggagccggacggaattttgcctgccacagcggcttcttcgcctttgagggccagcacttcgccattatccatgataaagcagttttcttcgggtatgccgcaatcagtcgcgagtttgacgtgcattttctgcattctgtactcaccgtgaatcggcataaagaacttcggtttgatcaggcggagcattaatttctgctcttcctgtccgccgtgtccggatgtatgaatgtcattcaatgaaccgtgaatgacttctgcgcccgcacggtacagctggttgatggtgcggcttacgctgattgtgtttccgggaatcggagaggaagaaaagacgaccgtatctccgggattaatggaaatctgccggtgcgtcccgttagcgatgcgtgataacgccgccatcggttcaccttggcttcccgtacataaaatcgttaccttattggcaggcatacgattgatttcgttatgctcaataaacgtatttttaggacaggtaatgtaaccgagattttgtccgatttcaatagccgattccatactgcgtccgaatacggcaacttttctgccgtttaaaacggctgcttcaatcacctgctgaagacggtgtatattcgaagcgaatgtcgcaaatataattctgccgtccacttttcggaaaatatcgtgaatgctttcgcctacgcggcgttctgacatggtgaaatcaggaacctcactgtttgtactgtcagaaagcaggcacagaacgccttctttcccgatttcagccatcttagtcaagtttgccggttcgcctaccggtgtgaaatcgaacttaaagtccccggtatgtacgatattgcccggcggtgttttgacgacgattccgtatgaatccggaatgctgtgtgtcgttctgaagaaggatacagacgtcttgcggaacttcacgatgtcgtcttcaccgatgatgtttaatttggtctgtcttaacagcccgtgctcttcaagtttattccgaagtaagccgatcgcgagtttaccgccgtaaacgggaatatttacttgtctgagcaggtacggaataccgccgatatggtcttcgtgaccgtgggtgataaacagacctttaattttatcttcattttttactaaatacgtgtaatcggggattacgtaatcaatgccgagaagttcatcttccgggaacttgattcccgcatcaatcagtacaatttcatcctgaaactgcaccccgtacgtatttttcccgatctcgcccaatccgccgagggcgaaaacggcagtctggtcattttttacaaatttcattccgctcataactccaatactttaaaattttcgctctgcttctcatattctaaaaaagcaccgtccacaggctgaacaaattcaatgttgtatttctgatctttcagtttcgttctgacgtcccgttctgaaacgccctcaatgtaaagtgaatctgttttttcccgaacaggtacttcgtcagccttctcttgataaaataccttataaatcatccaaatctctccttaaatgccgtatgttagactcgcttattctattatattcgaaaacggattataaggaaagtctcgagcaaaaaagggactttcaaaaaccgaaagatcccttctacgcgatgacttttttccggagcattccgccccactgtcttctgagtttcttccgtaatcggcgcagcattgtatacctcctttgaagccctttatagcagtagtatgcggaaaaactgaatttgttttcgtgggtaaaactggaatttcatcaaggcggttttccggaagaaaaactttctgtatgatgatattgaaaaagacacgactgataaacgggaaaaaggagaaattgacatgaaaccaaaattgattttttttgatattgacggcacgatctatgaccatgataaacatattcccgatagcgcaagaaacgccgtgacggcgcttaaagaggctggccatcacgtttttatcgccagcggaaggtccccgtttatggtaaaaccgattctggaagagcttgagattgaatcatttatttcatacaacggccagtatgtcgtatttgaaggtgaggtcatttataaaaatccgcttcctgaagatgcggttgcgcgtttattaaagcaggcggcagaaggggagcaccccgtcgtatttatggcggaagacacgatgaaaacgaccgtccccggacatccgcacgtctcggaaggtatcggcagtctgaaagcgccttatcccgaagtggatgaaactttttataaaggaaaagaaatttatcagctgcttttattctgccgcggtcatgaagaaaaagcatatgccgcttttccggagtttgattatgtccgctggcacgaattgtcaacggatgtgcttccgaaaggcggttcaaaagcggaaggcattaaaagagtgcttgagcggcttccgtacagcgtaagtgacacttatgcattcggcgacggactaaatgaccttgagatgatccattttgtcggcaccggggtggcgatgggaaatgcggttccggaattaaaagctgccgctgatttcgtcacaaagccggtggatgaggaaggaatcagctgggccgtcaaagaactgggccttttgaaatagagaaaaccggcactttgggaagtgccggttatttttaacggtcaatggcaatggcgttttcaggttctttgaacggattttctttatcgatatggtcgtaaaacatcacgccgttcagatgatcgatttcgtgctgaaacacgatggccggaaaacctttgaggcggatgtcaatctgttctccttcaagcgtcaccgcctttacgcggatgcgggcgtagcgcggcacatagccgggaatgggttcgtctaccgacaggcagccttctccgctcgtcaagtagcttttttccactgagtggctgacgatcttagggttaaaaagagcatagctgtataaagtgcctttcgcatcttctgcatggacggcgatcatccgtttttttacgtctgtttgcggagcggcaagaccgacgcccggacgaagcttgtatttctcggctaattcaggattttggctgtttttcacaaactcaatcatatcagcaagatgctgtttttcttcgtcagaagcgggaagctgaacctcttcagcgatctctctgagcgcgggatgtccgtcgcgaacaatattttccatagtaatcaagaaacttcactcctaaagcttaatatgtaaattatagcgaatttctttatcgcggcgcaacgaaacaattggccggccatagcaggccggccgatgttcatggtgtataaggtcagcagccgcagcctaaataagcggcaccgacgatgattaataagataaacaatacgacgattaatgcgaatgtgcggccgtatccgccgccgcagccgtaaccgtaaccgccgccataaccatatccgccgccgcaacaaccgccgccaaatccgccgccaaatccatatccgtacataaaaaaacctcctcttttaattacgctgaccctctgtcagcagggccggcgtctactataaactatgtaaaagccaaaaagatgtatggtcatccgccctgttttctcaattttttacgcaagtattctttgaaagcaccgtaagcgtctttacccggtcatgccaattacagctcagctattgtcaaaaagcgttcgggcttctatagtggaaattgtcaagattgggggattttaagtgaatatgattcaaaaaaaggtattagcaggaatcggagcgctcggcgccgcaagtatgctgcttgccggctgcgggggaaaagatccggttgaatcgcttcatgagtcgatggaaaaagccgttcaagcggaaaaaccgtttcaaaaagagcagaaaacattagaaaaattggagaaaaaagagcataagctatacgacagcgcggttaaactgaatatggatgattaccagaaaattgtcacactgtctgatcaggctctgagcaatgcaaatcagcgaaaaaaacatctgaaagcagaaaaagacagtattgatgattcaaaacaagcgtttgaatccgcaaaaaaaacttctcaagaaataaaggataagaaagtaaaagaaaaagccgggcatgcggtcgctttaatggagaaaaggtatgcatcttatgaccttttgtacaaaaagtacgaaaaagccatttcacttgataaggacctttataaactgattaaagataaaaagctcacattagcggagctggaagagcaaatcagcaaagtaaactcagtttacgaaaaggtgcataaacaagcagatgagttcaatcaatttactaaagactacaacaaagagaaagaactattattccgcaaatagtatagtgaaggcatatcggcatgggctgatgaactgataacaaccgagttcagccgcctgtaaaaaggcggctgaagaattggtatatacgtgtgtttcccattgacaacaagtaaatcatggtatagtatttatttagggaaatattcacataaaaccaatcgttgtttcggcacgttggaatgtttttattatattgatatatatataaaaacagaatgaaaatgtgattttaattatcagaaaattctatctatttatatttacggcaatatgatatttgtacatgctttttgcttttaaacctttatccggcataaaggtttttttattttgcttagtaatgcttattaagtaagggtgctgaaagtaaacgacaatttcaaaatcggaacgaaaagaaacggcagaaatacggaacaggaggaaaacaaatgcttgcttacgtctttcccggacagggagcgcagtttaaaggaatgggcagagacttattcgatgaattcagtgagctcattaaaaaggcagatcatattttaggatactccataaaggatttatgcctttcagacgaaaaagagaggctgactgatacgaagtatacacaacctgcaatttatacagtgagcgcactgcaatatttaaagggtttaaaagaaggttatacacgcccagatgctgttgcaggacatagtctgggtgaatatactgcgctttttgcggccggtgtttttaattttgaaacaggtctccggctggttgctaaaagaggcgagttaatgagtgaggcttccgagggcggaatggctgccgtgatcggactggatgagcaccacataaaaaaaatacttcaaaagtatgaattcggccaaatagatatcgccaattacaatacatcttcacaaattgtgatagcaggggctgcagaagagataaagcgggcagcctctttttttgaaaaagaaggggcgaaagcttatatcgtattgcaggtcggcggagcttttcattctcgtttcatggaaagtgcacagcgtgaatttgcggaatttatcgaggagtttcatttttctgaattgaatttcccggtcatttctaactacacggcaagaccttataaacaagaagatatcaaacggaatttaattgaacaaataacaaactcggtaaaatggactgaaagcatcaggtatctaatgggacaaggcgttactgtgtttgaagagatcggtcccggaaacattctgactaaattaattcaaaccatacaaagagatgaggaaccgcttactattagtgcgccggaagacagtctctttttttctgaagggaacaaggacaattcggaaagcgggaaagagcatagcctcttggccgaaaatatagagagcggtgcagcttcaccggtgtcccgattgggtgatcaatctttcaaagaagattacggtttgacatacgcgtatttggcaggtgcgatgcatagagggatctcttccgctgaaatgctgatccgcctcgggaagaaaggaatgctggggttctttggaacagcaggtttaacgataagggaaattgaacaggcccttatttctattaagaagacactcaaaaatggccagccctacggaatgaatctgcgatttgagccggatcatcaagatagagaaaaggaattgatagatttatatatcaagcatgacgtacgagtaatagaagcgtcttcgtatctttccgtcagcgcaccattaatttattacaaagcgcatcagttgaagatagacaaaagcggcagcgtcatacctcataatcggatcattgccaaagtttcacggccggaagttgcggccgcatttctgagtccgcctcctcaaagtatcgtaaagagaatgtgtcagaacggtatgctgacggaagagcaggcggagtggctcagccgtattccggcagcagacgatatcattattgaagcagattgcggaagtaatactgaacagggctcattgacggcgatgctgccgttttttgttaacctgcgggatgaaatgatggaaacacacaaatacgcaaggaagataaggatcggggctgcgggaggaatcgggactcccgagtctgccgcgtctgcttttttaatgggcgctgattttattatgacgggatccattaatcaatgtacagttgaagccgaaacaagcggttttattaaagaaatgctgagtgagacaggaatatgcgatactgcttatgcgccttcggagactctgtttgagttcggaacaaaggttcaggtgctgaaaaagggcacgctgtttccggtcagggcaaataaattatttcaaatctaccaacaatacgagtctttgaatgagatagatgaaaagacaaagattcagctcgaaaatgattattttaacaagacttttgatgaaaactacgaaagcataatagaaaaacagccgaacctggcccaaaaagctgagcgcaatcaaaaatataagatgctgttactatttaagtggtatttgcaaagaggatgtctgcttgctttggaagggcaggaagaacaaaaggtgaatttccaagttcattgcggcccgtctttaggcgcttttaatcattgggtaaagggcacggatttggaatcatggagaaacagacatgtcgatgacattggtgaaaaattgatgaatgagaccgaaagtctgctgaggcgcagattggatacgttatttctagactaaagaaggggcgggtggaggccaatggttcatttgaataaacagagtgcggatatcgcgataatcggggttgcttgcagattccccgatgcagatcattatcatgaattctgggaaaacataaatagcggcaaagattccatccgggaagtgccgattgaacggtggaatcccgatctttattattcagccgatatcagtataccgaacaaaacaatcagcaagtggggaggttttattcataaagctgaccatttcgaccataagttttttaatatctctccccgggaagcgaaaaacatggaccctgagcaaagaatccttttagaagaaacttggcggtgcatcgaagattccggggtttctttgcaggatctccagcgtaaaaccacttctgtttttgcgggtattatgaattctgactaccggcagacaggtcatgctgaatcggaaatcgacagttacgcctgtttaggaagtttcgaagctatgctttccaaccggctttcatacacattcggtttgaccggaaaaagcatgtctgtaaatgccgcttgtgcatcgtcgcttgttgctttacatgaagcggttaagtcattgcggacaaaagaaagcgattatgcaatcgcatcgggagtaaacttgaatttccaacccggaaaatatatttctttttccaaagccagaatgctgagtcctgacggcaaatgtaaaacctttgacgcagcggcgaacgggtacgttcccggagaaggggcaggcgttgtattgctgcagcgccttggtgatgcagtaaaagccggtcaccatatatacgggatcataaaagggacagctgttaatcatggcggtaaatcccgttccataaccgctcccagagcagaagcgcagagccgggtcatctcagaagctttacacaacgctgctgtcgatgctgcgacggtttcttatgtagaagcacatggcacaggtacatctctgggcgatccgatagaaatagaagcattgacaaaagcgtatcggcaatatactgaggatactcaatattgcaggatcggaagtgtgaaaacaaatatcggtcatacagaagcagcggcgggaatggccggattgataaaagttctaatgatgatgaaacaccggagggtgccgaaaagcctgaatgtacatacggtaaatccaattatacagtttgaaaaaacaccgtttaggccggcacttgattcaagtgattggaaggcggcagacggggctccgctcagggcgggaatcagctccttcggttttgggggtgtcaactctcacgtcatcatcgaagaatttatacatacaaaagacgaatctgacagaaaaggaagggtacccttccttttctccgctaaaagtgaagaaagcatgaaacaaatgatacatcattggagaaccttttctgacgattcagaggaattttgcaaaatatcaaatgaagtgatcagcagcacccttttaacagggaggacatcgtttgattacagggctggtttattggcaggcagcaaggaggaatttaaaaatcagcttaaagagggattgagttttcggaggaaacaagattctgaatgggcgcttgccatcggtgacttcaaatgggaaagctataaacaatttgccgttttgaaacgggtgttccctgatttagaaaagaacgtaaggccggtgctgaagggtataccaacattgcacagttcatttaaaagaaaatggacgcctgagaaaatccgcttgtattctttagttatcaatacggaaatcataaaaagtatcctggcatccggttttaagccaagcctcattacaggcgccggagacggatattacgttgctcttgcagcagcgggtatcatcaaaattgaaaaggccatttctgtcatcacaggcgctgaaaaaccttcgcacttatcctgtgagccgccgtccgttccatttgtcaatccgtacacttcaaaaacgtacccgccggttcgattaaatgaagaatatgtaaggatgctgctgaacggtctgagcttcccggctgattttacagaccgcctgtacgggaaaacacggctgcttcttgagcaccaatatacgtttaaaggttttttagaagagtgggataaagcgggaaagactcaggaaatcgagattttatcttatattgtgaatcgcacggcggataaaagaaacgcactgccggctgatgaggaagcggcgatcatggctatccttgcctctatgagaagactgtataagagatgggatttaacagattatgatggattctttaataatgattatgttctggaaatattaaatttactggacgaaggaattttgtctaaagaactttttctgagcatgttattgaaaaagcaagacggaattaaacaggctgttgcttgtattaatgagcagccggcagatttttatgataaggatcgttttccgttgatgacagaatacaatcaaatggatgccgtgtctcaggagatagctgatcatatgccgcttcacacggaagaaaagggaacggagacggatatggatatttctgatttttcagttttccaattcggatcgctccctccatcagcaaaactaaacaaagcggctgcttttgaagcggacaaaccagctgatgaggctctttatcattcatttatgcaaatgtggctttcaggagaagagattgaatgggcgaaactaggtgactatcataaaagaaaagccccgcttccgccttatccgtttgagcgctgtcaattttctttaaaccctcagcaggtaaaatcagacgcggctttttcagcaaagaagaatcaggcactttatacgccgatatggaaagaaaccgcacttgagaatgaagcggacagcggacaagcctgtactattttgctgttctccgagaataaagactattttgaagagatgaaaaaaagagagaatacgtccgcatatcttattatgcccggtgaccgtttagagcagataagcgatagtgttttcacgatcaacaggcagcgtcccgatgattatcaaagtgtcattcgtctgttaaaagaaaaaggcgcagcgcctgatgcaattttgcatacgtggtctgaaaaacagcctgaactggaagaaacactcgaatcaggaatttattccgtgttttatctgactaaggctttaatcagcgagaaccttataaacaaagtaacgttcatttatacattcagcgcagatcaaaaagaaaaattgccgtattttgaaggtgtgaacggttttttaaaatcggtaaaacaagaatatccgcagctgcattgtaagacggtttgctttgaacatgattctgcagccgtttcattttcagagaaggctgccattctttataaagaaataaacacagcacctgatcggcatattcatatcacttacagaggctgcgtaagatatgcacggatgttagagaagcagagagaaacatacacaaagaccattcaataccctgaaaaagataaagtatatttaattacagggggatttggggggattggcagtaaagtcgctgaatattgcgcgaaaactgaaagatccaccattattctatcggggcgatctgctttaaccggagataagcagaaacatttagaatacctgaacagctttaaagccaaggtttattatatacaggcgaatatatccgataaagaagcggtaaaaaaaatgattgacggtattaccgatcagcatgcaggtcttcatggcgtcattcattgcgcaggagttatcagagactcgctgctttttcaaaaaacaaagcaggaactttcagaggtgattgctccgaaagttcatggtgcgttgaatcttgatcatgcaacgaagtcgctggaattggattttttcgccgttttttcttcagtcgtctctattgcagggaacgaaggccagtgtgattatgcatatgcaaacggctttttagatcattttgcagaatatcgggaatggaaacggcaaaattctctgcgcagcggccgtacgctgacaatcaattggcctttatggaaagacatcggaatgggggcgaacctgtcaggtcaagggcggacgtctctttttcatggttccgggctcgaagaacttcctgctgaagacggaacgcaatggttttcgcggattgtaacttcgggtcagctgcataatattgcagtctgcggtgatcatgagcgctttgaacaatttatgcggcagagatttttgacggacgaaacagagacaggcagtgccattcctttggcccaaggcgatattttggatcagacagttttgtttttaaccaatatcatctcctctgaggtcggtgcagaacgggaagagatcgatcaagatgtgcatctggctgaatatggaatggattcggttatgattcatcaatgcaacacaaagctggagcagtcactgggagcaatttcgaaaacgcttttatttgaatttcatacaatcagagatttagcagatcatcttgtaaaggaatatccggatcggctggggcgtttattttcacgggaggaaaaaggaaaacagattcagagcattacccctgccaggccggaacaaaacatcactgcacctgcggcggaggaaaaagaacatcttgacgggatagcggtaatcggtatcagcggccgttatcccggggctgaaaatatcgaagaattgtgggaacttctatcaaaagagagaaccgcaatcacagaaattccgaaggaacgttggaattatgagacctactatgatccagaccccgctaaagcgcatgaggggaaaatttattgcaaatggggcggatttttaaagaacgctgaatcatttgattctttgtttttccaaatatcgccgagagaagcagaagcgatggatcctcaggaacgaatatttctcgaaaccgtgtggaaagcatttgaagattcgggatataccattgaagggttgagaaagcagaccgaaaaacatgtcggtgtatttgcgggagtgacgaccaattcttacaagctgctcggcgaaagaataccgacggacaaaaacgatgtacttccaaattcgttcccatggtctctcgcgaacagagtgtcttacacatttgactttacaggtcccagtgtccctgtagatacggcttgctcttcatccttaacggcaattcacatggcttgccaaagtttaaaaaaaggtgagtgctcggttgcggttgcgggaggagtaaatttgtatcttcatccttctgactatttataccgatgtcagatggggatgctttcaaaatcgggaaaatgcagaagttttggagaaggcggcgacggtttcgtacccggggaaggtgtcggggccgtaattcttaaaccgcttaaagatgccatacgtgataatgatactgtgtacgccgtcattaaaggaacggcaattaatcacggcggaaagacgaatggctatacggtgcctaatcctgccgcacaggcggatttaatccaaggagctcttaaagcggccggttggagcgccagaagtgtcagctttattgaagcccacggcacgggaacgccgctgggtgacccgattgaagtccgcggcctgaccaaggcgtttagagcttataccgaagatgtttcatattgctctctcggatcgattaaatctaacatcggtcatctcgaagcggctgcgggtattgccggcctgacaaagattatcttacaaatgaagtataaaaaaatagccgcaacactgcatgctgaacgggtgcatccggatctttatctggaagagacacctttttgtcttcagcaggaaaccgccgactggataaaacccgcgaatgaaaaacattctgacagcaaatatccgcggcgtgcgggattaagttctttcggagcgggcggggcgaatgctcatattcttgtggaagagtatgagtctgctgctgactgttatacggattgtgaggaaagtgaggaacttatcgtactctcagccaagcattcactgagtttacgggaatcggcaaaacagctggtggaatatcttcaaaaggcccgtcaacaacagggcgagtttttgcagcaagcgggaacaaacaagccgcttcacctttctgatattgcgtatacccttcttgaagggcgtgaagccatgccggaaaggcttgctgtcatttcaaataatatcgatgatctgatgttgaaattaaatcacttttataatggaattgacgatcacgaaatatttagagggaaaaaactgaatcataaacgcagacagcagcaatcggatcttccgctcaaatccggcagaaccacattagccgaaatggctgaattctgggtatcaggaggcaatttaagctgggaagatttccgcactggcagaaaaccggcgaaaattaccctgccgacttaccctttcttaaaaaacagactgtgggtgtcaaataaggcgcaatcaaaatcaacagctgataaagctcctttatttgatttttctgcaggtgagtgccgattttataaaacgctttcagattctgaatattatgtaaaagatcatgttgtgcatgggaatatggttctgccaggagcggcaatcatcgaagcggccagagaagcgggagagaggctgtacggaaaatcagtcataaaactgagtcaggttgtatgggcggttccaataaccgttgagaaagaaaagacggtaatgatagatctgctgccgaatcaaaaagacggcagatttgtggtgaaaaccgatatgcaacctgaagcggcggttcattgccaaggaaacattatcacatgcggagataaagatgcctctcatacagagcgttttcaattggacagctggttaaccggacagaaaagattaatcagcggcgctgagtgttacagggatttccggcagagcggtttggactatggaaccagttttcaggtaataaaacagctgtttatccatgaaaatgctgttcttgcacgaatatcacttcctgagagcattcataaaaaatccggcacgctgctggaaccgtgtttattggatggcatttttcaatccacaaccgggtttacgtccggtcaagaaggagatctcaccgcatatttgccttttgaattaggtgagctggagattcttcatgcaccttcggcaaacggctatgcttacattacagctgccgatgaaagacaacatgatgatgtcaaaaggtttcatatattatttatggatgaaaacggatctgtaagtcttaaaataaaaaacttagcgttgaaggcgttaagggctgcaccgcagactcaggatgagcggcattcagttaagtattacactgatatgtggaagcgggcccctctgcttcatcagcctgaagccagcggtttaaacagctgccttgtgatttcactccgtcgggatatatcagaaccgctgatccgccaggcatataaagatatcggcttgaacatgatctttgtccgccatggcggcagttttcaagaaaaagaagctgattcctttgaattgaacagcgtcaaacttgaaggctatcagaaattgctggcgattcttaaagaaagacaagtgacaattgaccgcgtcattttaatcgggatgagccctgaaacgggaattgagcagaacattcatgaaaagctggaagaggctgttttgccggttttcaatgtaacgaaagctctgctagcaacaatcccaagacataaaatcctgatatcacatgtatttttcacaagggaaaatcaaatcttaccttatcaaatggcaatcagcggcttttttaggtcacttcatttagaacatccaatgttgtccggtaaaaatattgaaatacaaagcgatgaaattcagttacagctgaacaccggtctgcctgaattaaaaaaccttgtgaaagaaacaatcatcagcgatgatacttcagaaatcagatacagagatggaatcaggcaggtcaagcactctgcagaaattgaaagtgccgagccccccaaaaagatggaagtaaaagaagggggagtttacctcattacaggaggaacgggcggtctgggactgattttcgccagacatcttgtgcgaaaagggagaataaaacttgtccttatcggcaggtcagagctttctgaggaagccgtaagcaatgtaaaagagctggaaaaaaacggatcagaggttttttatgtaagaaccgatatttctgataaggaaaatgtcaataacctgataaacctcgtcaaaaacaaattaggtcctgttaaaggaattattcacagtgccggtgtgataaaagattcattactcatcaataagcgtgaagaggatctcgattcagtcttggccagcaaggtttacggaacgatatggcttgaccggtatacagacagagaacctctggacttttttgtaatgttttcatctatcagcgcaataatcgggaacgcgggacaaaccgattatgcttatgcaaaccggtttatggattattttgcggaaatgagagcggcggaaaataaacctggaaaaacagtctcgatgaattggcctttatggaaagaaggcggtatgcgaattgatattcattcagagaagttcctttatgaccgtttcggaatgctgcctctgggaaaacgggaaggccttgcagcatttgatcaagcaatgacagggtgtgaacatcaaataatggtatttagcggtaatgaattaaagctggaacgaatgataacgattgacagcggaaaaagtgacccggcaatcgccgacgaaaatcacgaaccgaaagagctgtcaataactgaatctttaaaaagcactttgacgcgcatcgtcaccggcgtattaaaaattgaagaacgggaatttgattttgaactgccgataagtgaatacggatttgattcaattatgtttacaatgctgggcagcgaattaaacgagtcattaggaatatcaatgatgccgtcagattttttcggtcttactgattttaatgaacttcttgagtttttaaagagtgagtattccgaggagcttcatctctgcggttctttttcttcagatgaatctgcggcgaaagaccggagagaaaatctgattgagggcatcgcaaagatgatgtcaagtattttgaagattgacagaaaggaaatagaagaagagacttcattcggcgagtacggatttgattctattacgtttaccagactcggaaatgaaatcaatcaacaatatggtacggaattattgccgtccattttctttgaatgcaattcactggctgaaatgactgattatgtaatcgaggaatacggagaaatcctttttgctgagacagaatctttttctgcagctgacgaaaaaacattgtacagcacgcctccgccggaatcttatgaacattcccctgagcctgaaaataaaactaggcaagaggaaagacatataaatgagccggtggcaatagtgggaataagcggccgtttcccccaaacagatacgctggaagacttttgggaaggaattgaaaaaggccgggatatgattacagacattcctgaagaccgttggaactggaaagagtttgacggcgatccgatcagggacgtcaatagaacaaaaataaaaaaaggcggatttatcaaaggcgcggacagttttgatccgttgtttttcgggatttctcccgccgaagcagaattaatggatccccagcaaagaatttttatggagactgtatggaaaacaatagaagatgcgggctataagccgtctgatttggcagggacgaaaaccgcggtgtttgcaggggtcgccacaacggattatgctgaacgtctgaatgaaaatggcgtctctgttcaggcgcagaccgcaaccggtttaaatcattgtatattggcaaatcgtatttcttaccagctgaacctgacgggtccgagcgaaccgattgacactgcctgttcaagttcgttagttgcgctccatcgtgcggctgaggggattcaaagaggcgattttgaaatggcgattgcaggcggagtgcatattatgacaagccctactctgtttatagcttttgataaagcagggatgctttccaaagacggaaagtgcaaaacgtttgataaaagcgctgacggctatgtaaggagtgaaggggcggctgcagtattgctcaagccgctcagcaaagcacaggcagacggtgatcatatatatggtttgattaaaggatcagctgtaaatcacggcggccgcgccaattctttgacagctccgaatccgaacgcacaggcggacttattaaccgaagcttggcggaaggcgggggtcagccctgccactgcgggatatatagaagcgcatggcacagggacaagtcttggtgatccgattgaagtgaacagcatcataaaggcatttaaaacgttatatcaagaatgggacattccttttgcgaaacagaaatgctgcgggatcgggtctgtgaaaacaaacatcggccatctcgaaaccgctgccggaatagccggagtgctgaaagtgttactggcttttaaatatcgcaaacttccgggactcgcccatttttcagaactcaatccatacatcaaactggaaaatacgccattttatatcacagaaaccgctcaaaagtggaatccgataaaagatgaagagaacaaagatctgccgaggagagcaggcgtcagctcattcggattcggcggtgtgaacgcgcatattgttttagaggaatatagggaacctcaaaaagaagtgccggaaaacaacggtaacacacatatttttgttttatctgcgaaaaccaaagatcaattacttgagtatatccggcatatggttcagtacttggatcgcgtgattgccggtgacatgaccgttaatgccagtgacatggaatttacattgcaaaacggccgggaagcaatgaacgaaagaattgccgtatgtgcagcgagtctgactgagctgagagataaatacgtcagctttcttgatgacagcaaggtgcaaaaaggcgtatttataagcgaaatcactgaagagcgcacagctgtttctgaatatatgattcaggaggctcttcaaagcggaaaagaggagctgctcgcacaatggtgggccaatggagccgagtttgaatggaagacaatcggcaataagaaattgaatagagtgccgatgccaacttatccgtttgcaaaagagagttattggtttactccgaaaaagaacaaaagcgaggttaatagtaaaagtcttcacccattaatcagcgagaatgtctcaacattaaagaaacaagcatttaaaactgttatttccggaactgaatttttcgtcactgatcatcttgtttcaggagactatgtgctgccaggagccgcttcgcttgaaatggctcttgtttgtgcggaaataagcggagaaagtaaagtatataaaataaaagacgtgatgtggaacagacctatattatataaaggaaaaacgctgcacatttataccgacttggaaatgaaacaagataagttgaacgtaatgatatgtaaagagggtccggatggcgtgcagcaaatctgcacacaaagtgaaacagtattcggagacataaacagcaatcctgagtatgtcgatattgatcagttcatacgcagcagtgagccggtcataagccgggaagagtgttatcaccgcttcagccgtatgggcctgacatatcatagcagttttcaaacattgaaagccgtatatcgcggtgatatggagttaatggcagaattggagcttcctgctcatttagcgaacgggttttcacattttacacttcatccttcattaattgacggcggttttcaagcggcggcatttttgttaagagataatgagaaagagggcttatttgttccatattcacttagagagcttcacattaagagggcgcttactgcccgatgccatgtctcggtgaaagaaaccggtttttatacgtataacattgattttattaacgagagcggcgaaatagccgtgagcatgaaagacttttctgtcagaaaagtgaccgggggagaattaaccgcaggacgtaaaaatgaagatcaggaaattctcttcttattagaacgattgaaaaacggtgaactttctgctgaccaagtttatcagctgctggagggaaaatagtgcagatcaaacaaatactttccttaattgaagaacagcaaatgtctcctgatgcaggactggagctaattcgcacttacagaaaagaacaaatggaaaaaaaggcggagccggaatcacaagctccgtccccaaccattttttttaagaacgaatgggtaaggacaaataacattgataggccgaatcagcaggcaccgggaaatatgctgatttttgatcaggataaccgtctttttcagcatgccgagatgatgaatggagaacataaccgtgtcattctcgtaacgcccgattctgattatagaattgagcggaatagatgcacaatcaatccttctgatgaaaatcatgtcgaaatgctgctgtctgatttggctgaaaacggatttacacctgatgtcgtgctttatttatggaacggagaaatcagagatttcactgaagaatccgttaacgaaactcttcgcagagggataaactcgctctttttattatcaaaagctttaatgcgaagaaacgaacctgttacgttattgcatatttattggacaagcggtctgaatcagccgtttcatgaagctgtcggagggttcatgaaaacggtaaacatggaaagctccaagcttaaagcgaaaaccatacagattcgccatgagcattctgagataaatcctccggtttccaaggtgtgggatgctgcaatcagtgaaatacagcactttcaatccgatgaatgtgaggttttaatagactcacatacccgttatgtgaaagggctgcagcatattgataatccggaacacgataacggatctgtaacgtatcaaaaaggcggcatatatatcattaccggaggagcgggaaaactcgggctgctgtttgcggaacacatcgctaaagaaaaccaagccgtgattatacttacaggccgttcttttttaacagctgatcaaaaagaacggatcagtaagcttaatgagagcggctctattgttgaatatcagcggacggacataacaaatcgaaccgagacagagcgattcattttcggcgttaaacagcggtacggcagcataaacgggatcattcatgctgccggcatccttcgtgactcatttcttgtaaataaaagtctcagtgattttacggacgtactgaacccgaaagtttacgggacaatctggctggatgagctgacaaaagacgaagatcttgatttttttgttctcttttcttctttttccgcttacggaaatgccggccaaagtgactatgcgtacgcaaatcattttatggacagttttgcagtgcttcgatctcagctctcccgaaacggaaaaaccctttcaatcaattggccgttattgaaagatggcgggatgagtctcgacagcaatggaatcattcaaataaaagaaaaatacggaatgactccgatgcgaacttcctctgttttggaagcgtttctgaaaatgctgcggtcttcatttaccagcttaatgcctgcagaaggagagcgggataaaatgataaaagcgctagcgattcatagaaatacagctgcagcagatcaagatacactcacggcggaacacgatgaagaagaggaatatgctgcgaaagaaaaagtcaatgactatttaatcaagatcatcagcggtgtcttgaaaatccaatctcataaaataaatgcgaaagactcttttgagaaattcggaatcaactcacttatgatcatgtcacttatttcaaagcttgaagatactttcggggatcttccaaaaacaatcttttttgaatatcagaacattgaagagctttcaaacttcttcctaacatcttttaaagaaaaagtgcttaaggccgcaggggcagctccggtaacaagagtgccgaagaaaagagaaaatctgagtaaaaaacagcaccggcagcagaaggttgcatctgcaccgagcatggttccgccgggtgaggatattgccattatcggtgtgagcggaagatatccgaaatccgatactcttgaggagttctgggaaaacattgccggagggaaaaactgtattattgaaatccccgaggaacgttgggatttcagatcgacttacagtcccgacagaatggagaaggggaaaatcaacagtaagtggggcggttttatcagcggtgttgatcaattcgatccgctgtttttccatatttctcataaagaagctgagctgatggaccctcaggagcgaatttttctcgaaacctcctggcatacgtttgaagattcaggatatacaaaagagaagcttgacagtatgaaagccggtgtgtttgtcggagccatgtacggacaataccaattattcggcgcagaagaaactgcgcggggcaatccgatcgcgctcagttccttcttttcatctattgcgaacagggtttcatacttttttaatctctccggcccgagcattgcactggatacgatgtgttcatcatcgctgacggccattcacttggcatgtgagagcattaaaagaggggaaagtgaaattgcgcttgcgggcggcgttaatgtatccatacaccccagcaaatacctttggctgagtcaaggtaattttgtttccaccgaaggattgtgcagaagtttcggagagggcggagacggctatgtgccgggagaaggttcgggagccgtcctgttgaaacctctggaaaaagcaattgccgatcaggatcatatatacggagtgattaaaggaacatctgtaaatcatggcggaaaaaccaatggatttacggttccgaatccgaatgcacaagctgagctgattgctgaaaattttaagaaatcgggcatcagtccgcgatccgtcagctacttggaagcacacggaacgggtacctcgctcggagatccgattgagatcgcaggattgacaaaagcgtttgagaaatttacggatgataaacaattttgtgctataggttcagtgaagtctaatatcggacatttggagtctgctgcaggtatagcagctcttacaaaagttcttttacaatttaagcatcagaaattggcgccatccattcactcggaacagctgaaccaaaatatccgatttgaaaagacgcctttttacgttcagcggaaagaagaagagtggccgaaagaatcaggcgcctccaacaggagagcagcaatcagttcgttcggagcgggaggagcaaatgcccatgtcattgtggaagaatatcaaaaccatgcggacacacaaacaataagcgggccgtttgccgcagttctctctgccaaaaatgaagacagactgaaagaatacgcccggcgccttctgcaattcacagagcgggagacaaaggcctcggcagctgatatcgcttttacattgcagacatgcagggaaccgatggaagacagacttgctgttgtagcttccgatttgccggagcttaaggagaagctgagaactttctgtactgaaggaacaattggagagggcgtatacaaaggcaatgttacgaaagattttgataaagtctttatctttcatgatcaaaagatgaaagataaattcctcgaggtgatgatggagacaaaggacttgaatcttcttgcaaaattatggtctttcggggctgatattcactggagagagttatatgaagaatataccccgcaaaaggtcaagcttcctttatatccatttgctgaggagtcttactgggtgcctcgaaatcaaagtgcaatatttccggaaacattgccgcaacagtcttcactgcacccgcttctggattcgaatgaatctactctggaacagcagttttttaaaacgacattaagagaaaaagagatttggttaaaagaccacattgtaaaaaacaagagcattctcccggcagctgcttttcttgaaatggcatgcgcagcgggaacgcggtcatatcgaaagaaaaaggtcactcgtttaaaaaacgtgatatttgccagaccggccatgcttttgcaagagagcctgaccatttacactcacatttccgtaaaagacggcagcatattatttaacatgtcacctgacgaggatgctgctgtaaggactggatttgtgacgggggaattatattatgatcatcattacggtgatgatgatatagagaacatcgacagacaagagatgataaacagaagtgcttttgtccgtgaacaagatgaatgttacgagtattttcgggaaaacgggttcctgtatgggcgcgcttttcagccgattcaacgtttatggggcggcggaacggaagcggttgcacacttattgctgccaaaagaagccgcatatgctcttgaaaattatacattgcatccgtctttaattgatggggctctgcaatctttgttcggaattaccgacggaagagaagaggcatctgtttatgttcctttttcaataggagagattacgattcggaaaaaagtttcagcagaatgctgggcttatgcgcgtaaaacaggccaaaaaggtcaatccgagcttatttacgatattcagctgcttaatgaacacggagagagacttgcaggtttgaaggatgtaaccattcgtaaaaaagaaacgttttccgcggagacgcagactcgtgcaacagcggattccaatggaaagaacgagagagtaaaagagctcctcagacaattaaaagcgggcgaactgactgcggaggaagcagattatgcgctggagcgtatgcaggattagtttatcattttgcggcagtgccatttgtaaaggggatgaagatttttatgaaagaagcccgtcatattagaaaaaaagtactttctgacatagaaagcggcatcatttctttggaagaaggagtaaagcggatacagcagcttggttctcattccgcagggggtaacggacaggcgatatattatcagacggtctggcagcggacagatctcagcattcatgtaaaaggcggccggcgtgagggcagccttttattatttgataaaaatgaaattgtgagaaatgaacttgctgcattgcatgatacaagggttattttggttaagccggggaaagagtttcgaaaaaccggggacggtgtatttgaaatcgacccccgctctgaaagagattacataaacctgttaggatggcttatagaagaagagaagtcagatatacgggaagcggtgcatttatggtcagacatgccgtttgaaaagactgagagagcgattcgtgaacaatgcgacagcggagtctattctttgtttttactgcaacaggcgctcttcaaaaataactgccgcaaaccgatcaagctgttatacggatatttttcgcatctttctggagaacagcctctttacgcggcggcaagcggatttttgcggacattgcagctggaaaatccgttaatctcagcaaaaagcattgaattggagcagtcaatagcagccgttcacgcggctgatatcatacgcaatgagctgagtgatttccagccttcagatgtagagatccgttataaagacatgcagcgttatgttaaacagctcaaaacgtatgaacccgaaaaaaattccggaagcggagatgtgccgctgagagaaaatggagtatatattatcgcaggaggcgcgggcggattaggatttacctttgcagaatatttggcttttcaaacaaaatgctgccttgttttaacggggagatctccgctttcagatcatataagaaaacagctgagacgattagaggatgccggttcttcagctgtttatgttcaggctgatattaccaataaggaagaagccgaatatgtagtcaaaaaagccaaaacttcttatggaaaagtaaacggggtcattcagggcgcgggaatcatccgtgattctttccttcttaacaagtcacgagaggaattcgatcaggtaatcagaccgaaagtattgggtacgatgtggctgaatgatgctgttgagaaagaaaatcctgactttttcatttgcttctcctctacttccgcagtgttgggaaatgtcgggcaatctgattacgcgttcggaaacagttatatggatcatttcatgaatatgcgttctgcccaggattctgatacgatttctctctctctgaactggccgctgtggaaagaagtcggcatgcaagtggatgagcgcacggtagagacaatgaaaaaggcgggtttttatcctttagaaaaagaagaaggtaaagaagcgtttgcagtcgcattgtcctccggtttttcgcaatttactgtattttacggagatgagcaaattgacaatcatgttcatcaattatatgaacgaaaagacaatattcaggcagatgaaggaacagggagaaatatcgaatcatttgattcagagaaactgacagctgaaacatctgattttattataaaaatgattgctgcagaattcaggatgcctgcggacaaaatagatgcagaagaggcattggaaaaatacggacttgattccgttatgattatcaatatgacgaatgagcttgaaaaacatttcggcgcgctctcaaaaacgctgttattcgaatatcagactgcggcagaattgtcacagtatttcgttgaggagcacagggatactcttcttcataaactccggttaggagaaaacaggagcagcaccccatctcagaagaaaaaagacaataaacagacagccgaagttaacgggaaacagaaaatccagatgaaaaatcaggtgcagcagcaggagaagtatcatgacaatgatatcgcgattatcggtatcagcggacgttacccgatggcaaatgatcttgatactctgtgggaaaacttattgaacggtaaagactgtataactgagatacctaaggatcggtgggattcggggctgcactatcagcccgcagcgggcgatgaagtaaaaaaccaaagcaaatgggggggatttattgacgatgtgtatcattttgatccgttgttctttaatatttctcctgccgaagctgaattaattgatccgcaggagagactgtttttagagacggtttggcacaccatagaagatgcggggtacgcaaagaaaacgcttgaaagaaaaaacgtcggtgtttttgcaggggttatgtacggccaatatcagctgtacagcgttggtcacgaagcggccgtttcttcctcatatgcatcaatcgccaaccgggtatcctacttctttaatttcagcgggccaagtattgctttggacacgatgtgttcctcatcattaacggctgttcattttgcctgtgaaagtttaatcaggaatgaatgtgaaattgcaattgcaggaggcgtcaatttatccattcatcctcataaatatgaactcctgactcaaggcggatttttatccagtgatggccggtgcagaagcttcggttcaggaggagacggctatgtgccgggagaagggacaggtgccgtgctgctgaaacccgtaaaaaaggctattgccgacggtgatcagatttattcagttattaaggcaacagccatcaaccacggtgctaagacgaatggatataccgtgccgaatcccaaagctcaaagtgaggtcattacgagagccttaaaaaaagggtttattgatccaaacagcatcagctatatagaagctcacggaacaggcaccgcgttaggagatccgattgaaatcaccggtctgaccaaagcattttcaggtgccgaacgcgataagaagacatgcgcgatcgggtcgattaaatcaaatatcggacatcttgaggctgctgcaggcatagcgggcattacgaaagttattcttcaaatgaaacataaaacaattgttccgtcactgactcattctgctgaattgaatgaaaatataccgtttcaaaaaacacctttttatgtaccggacagtgccgaaaaatgggagtcatccgttcccaagcgtgccggaatcagttctttcggggcaggaggagctaatgcccatgttattttagaagaatttgcggctgaagctatctctcctctcgcggctgaagaacctgaacagcttttatttgttttttctgcaaaaaatgccgacaggctggcagaatatgcaaaacgcgcaaaagaacatatagcagccagagattatccattagaaacacttagaaatacagcatttactttacaaaccggcagagaagaaatgccgcacagattggctgttatcgcctccacaagagatgaattgcttaaaggactgacagactataccctcggaaacgcgatggatcatatttttacaagcggcaaagacacaacagaagcaaaaaggatgaacaaagctgagattgaagaagcagccgcaaacagggatcttgtgaagattgctgaatactgggttgccggaaacggggtagattggccgtcactttataaaggtgccactctgagacgggtatcagcacccggatatccatttgccaaagagctatgcagaatagatgcgcaaaatacgggaagccgccggatgaacggtaataacgatctgcatccttacatttcatgcaatatatctgattttaaagcacagaagtttcttatcaatgtaagcgataccgatttgtatataaaaacaaagtatcaagacaaggaaatgtttccgtttctcagccagattgaaatggcgagagctgccggagcaatggcttcagggaatccgattattaaattaacagagctctcctttagagaaccgatgttacaaagcggaagcaatgagcagatccggattgtattaaccgcggataatcagggtgcatcgtattctatagaaaaacagagcgactcatccatttattcctcagggcggctcgaattagaaggcggggcgtacgagaacggaaatattcatcttgagccgttcctgtctcagcgcgcagaccgcataccgtatgaagcattttatcagcggcttgccgaattcggatacagctgcagtgacagtctgaaagccgcagagcaatgtgtcagcaggaacggacaggtacttttaaagataaaagcaaaggccgagccgaaagggtgcataatcaaaccggaagttattgagagcgtatatcaagccgtcatataccttgcgggggaaaatgccggagagctcccggaaaatattaaagaatgtacgatttttgatcatgagactgaacccgtttatgtatatgcagaacaaactgaagaaagcgattcggcttatgatgtgtatgtattagacaatgccggcgggattttgatggaactgagcggactgatttttggcggaaagcctaataaaaatgtacgtttttatgagcataagtgggatcaaaaaaaccctctgattgaaatgaaagatagggagccaaaaacaattctggtctttgcaaaagatgaagcattggctggagctctgaaaaatcaatcagacagccgtgtcattctcgtcacgccggatcagcggcagaccgatcaaaatctgctgacattctgtgtaaacccggaagtgacgtcagattatattcgtttattcgaagaattggagaaaaaggggttttctccggatgtcatcttgcacacgggagaaacattttacgcgggtgaccgccttctcagcggcctggaatcaattttttatttattaaaagcgctgagcgcccgcagtgacgcctctctttatcttcattctctgcttcttgttcactcttttaaagaaggcgtgaatgatccgtatacgggcgctcttgcaggctgtttaaaaacggcgaatatgttggtgccatccgcagagaatgtgaagtcaatcggtttttcagaacgtatatcaattgaaaaaatggctgaattttgtcttaacgaaatggtttcaggcgtggaacggcaggcggaagaagttaaatatataaatgacaagaggtatgttaagacattaaaggagtatgtattcaatcatacagagcaccctcatcagctgaaacaggaagggatttacctcataacgggcggtttgggcggtctgggcctgattttcgcaaaatatttagcctctcagtatcaagcaaaattagtattgacgggaaggtcaccgttaacagctgataaacgacataacattgaccggctgcaggcgcttggaggagatgcggtatattatcaagctgatgccgcagatcaaaagacgatgggacgggtcatagaagaaacgaaacggacttggggctccattcaaggcgttattcattcagctggtcatgccgatgatcggttatttacagagatgaatctgactgatttttcagaaggcatgactgctaaaattgaaggaacggtatgcttagatgaattaacgaaagatgagccgcttgatttctttatcgtattttcttctatttctgcggtcttcggagattttggacaggttaattatgcgttgggcaattattttcaagatcaatatataaattggagatccgaacagagccgccggcaagagagacaaggcaagagcatttcgattaactggccgttgtggcgtaaaggcggaatgcatttaaacaaagaagctgaagaagcatatctttccgcatccgggtttgattatttggaaacggaagaagggatagcggcttttgaggcgattttggcaagtgactgtccgcaaatttcggttgttaccggggatgccgaaacgacaccagcaaaaaaagatctgccgcatcaaaaagtaaatacgcttccggttcgtcaagaggaaatttcttatacagcaccggcttatacagacaatgtcctggaagaactgaagcaaatggtatcggaattattgaaaattaacattgaacagctggatacggcagagaatttcggcaatctcggctttgattctatcagtttgaaaacattagctgtccggctgaataaaaaatacaagcttaagctgacacctgccgttttctttacttacagccatattaagtctctttcagaatttctaaacagtgaactgcgtactgttgcaaaagggaatacagatgcagaaaaaaacatttctgaaaaaaggaaagtgcacgccgagaaaaccgccgggaaaaccgtgaagccgccgcgaagttttccgtttgaaaaaaagacaacaagacaggctgactatcatccagagaagcagccagttgccattatcgggatgagttgtgtttttccgggatcaaaaaatgcagatgagttttggatcaatttaatcaatgaaaaagatttgattcaggaaattcccccggatcgctgggattggaaaaaatacgccgaaggcaaaggaagcagcgaagtacattcgaaatggggcggctttatcacagatgccgataaattcgatgaggcgtttttcaatattaatccgcgggaagcagaactcatggatcctcagcacagaatttatttgcaggaaacctggaaagcgatagaagatgcgggttacaaagcttcaaagctgtctggcaaaaatatcggggtgtttacgggcattcaatttaatgattaccgccagctgctgatgaggcattcggacggggcgcatgcgtttgcgggaaccggaaacagccaggcgctcatcagcaatcgtgtatcccactattttaatttcagaggtccgagtgagtccattgatacagcctgctcaagcagtcttgcagcaatccacagagctgtgcgctcgattcaaaatggcgaaagtgagctggcggtagcaggcggggtttcgctgctcttagatccagtcacgcatatgtatactgataaactcggtattttgtctagggacggccggtgtaagacgtttgataaacttgccgacggttatgtccgcggtgaaggtgcagctgttctgttattgaaaccattgcaagcggcaatgaatgacagagacaatatttacggagtcctgagaggaaccggagaaaatcacggaggaagatctgcttcattgaccgctccgaacccggaagctcaggctgaactgttaacgtctgtttacaaaaatgccggtattcctgttgatacgatatcttatattgaagcacacggaaccgggacagaactgggagatccgattgagattgaaggcttgaaaaaagcgtttggatcttttgagccgcatccaggaaagaatcatgaccaatattgcggcatcggttcagtaaaaacgaatatcggtcatttagagcccgcctctggaatgccggggctgattaaagtattactatccatgaagtataaaacattgcctgccacacttcatgtcaaggagctgaacccttacattcaattaagcggaacaccgtttcatattgtcaataaaacgatgaagtgggccagattaaaagatcgaaaaggaaatgaaattccgcgccgtgccggagtcagttccttcggattcggcggggcaaatgctcatgtccttgtggaagaatttgaatacggacaagataaagcagtaactgccgagcgggaacaaatcattgttctatcggccaaaacaaaggaaaggctgatggttaaagccaaagagttaacaacgtttttacatgaagaacgatcagttcaattcagtcagcaagaggtgcaggaacgtgatttacaagaggcggttcgggaagcggcagcgggtatcctgcgtttagataccgcagatatagatgcaaagacacctctttcggaattcggatttgatccgttggcttattccgaattaatctcttttataaaccaaatgtacggcacagaaatatcacttgacatatttcaggaattaaagacactgagcgagctgtgccgctatatcagccgcatccggaatcgatcagctgataaaccgcataacggcaattttagagaaaagtccggattcggtcttgaagaaatagcatatacgctgcaaaccggaagggaaccatttgaatgccgccttgcgatcacttgttcgaatgccggagatcttcttgaaaaattaaacggttacatccaggggagcaggctgcaaggtgtttatgaaggaaatgtaacggattttgatagtctgtacgctcctttattcggcggccccgaaggtcatgcatatgttcaatcactgattcagcaaaacaagccggccaaactggctcagttgtggacgatcggttgtgaaatcagctgggaagacttgtatgaggaggaactcaaaccggttaaactgtctcttcctctttatcctttcagcaagaacagacattggattcatttaaataaagatgaagcgcagaaggctgaggctttctcgaacactgagcttcacaactcaaataaagatacagcagatggagaaatcatgtcgcttcttgaaaaagcacaaacaggtgagatgaatacgaaagagacgtcagagctgatagaggagttgcttttccatgaatgaaaaaacgatgcaaattgagcaaatcgtgaaaaaggtgaaagaatgcagcctgacgcctgaagaagggctggaattcattaagagcttggggaaaacccatctatatgaaatggtatgggatagacatgaatttaaaggcagtgaaaaattcccgcatacgaaagagccaattttatttttttgcgaagacgacagcatgtataccgtaatgaagaggcagcttgaaggctatgaggcacctttcatttacgtgacttccggcgagcgtttcgaagattgccggaacggtcgttttacaatgaactttgcaaaagatgaggattatgatgcgttatgcggggttctgcgttctcaaaatataaaaccccgccatattattcattttttggctgccgggctcttcaaaaatacggaagatgcaatgagaaagcagctcaatgaaagtctgtattccttgtttcaaatgtttcaggccttcatggcgaacaaactttgtccgaaagcagaaattttgtacctgtatgaaaataccgagggcgaggttcagccgatttataacgcggttgaaagttttcttaagaccgtacaggccgaaaatccgaatttcacatgtaaggctgcagagctgaaatcaatgtttgacgagccgtttacaaagcagcatattgcagatgtcatctcttttgaatggaacaatcaatgtaaaacggaccactttacctgctatgagccgaggcattattataaaaggcagcttcaaagagtaaaaaaagaagatggggagaaacaaagtttcagtgtaaaaaagaacggtgtgtatttaattacgggaggagccggcggtctcgggtatctgtttgctgaatatctggcgaaacaggcagaagtcaagctggtattaaccgggcgttccccggcctcccgtgaaacggcgcaaaaattgagcgctcttgaaaatcttggcgctgaagccttatatgtcccggcagatatttcaaaggaaaaagagacggacgctttgattaagcacattaagcagacattcggagaattaaacggaattttgcacagcgccggacttgttaaggatgcatttatcataaaaaaaacgaaagaaagcatagaagaagttatagcgcctaaagtattcggaaccgtttggctggataaagcagctgaagaagagcctcttgatttcttcgttatgttttcatccctttcggccgttctgcctaatgcgggtcaaagcgactacgccttcgctaacggatgtatggacggattcacccagtatcgaagcattaaaggacgtcccgggaaaacactttctattaattggccgttatgggatgcgggcaatatgacagtcgggccgggagagctgcaagctttaagacatgcagggctggaacttttatccgcccaagcagggcttgccgcttttcaggacagtatgagccgctctgcttctcagctggctgttatcagcggagacaaagatagaataagtgaattactctcaactgatcataaagaaatagagactgtgcctgaaaacaacagtaatctgccgcaattaaatgaaagggatctgaaaaaacaaacggttcgtcttttgacagagattgtcggtgcggaaacgggaagaccggcggacagtattttacccgaggatacgtttgaccgttacggaattgattctctaacgattttaggtcttaactcccgtctggaaaaatattttggaagagtgtctaagactcttttctttgaatacagcagtgttgaagagctgtcagagtattttcttgaacactatcatcatgagttgaagaaggcgtttttaccggcagccgaacagcgaattgatcattcggcgccggcgaaacgggagaagctttccatttcccgcataccatccgcaccttccgaggaagatattgcaattatcggtatagccggccgctacccgatggcgaaggatgtggaacagttttgggaaaatatttgttccggaaaagattgtataacggaaataccgaaagagcgctgggattttcggaaatattatcacacaggtgacaatgcccgtcatgacagcaaatggggaggttttataaaagacgctgataaattcgatccgctgttcttctcaatttcgccccgtgatgccgagttaattgatcctcaggaacggttatttttagagacagcgtggcacacgtttgaagatgcgggttacacaaagaaaaagttgaaacggcataagacaggtgtatttgtcggtgtcacctacagccactatcagttatttgcagccggtgcttcagatgatgaggaacgtcagacgctcttgtcttcttattcgtctatcgcaaaccgggtgtcatatttctttgacctgcacggacccagccttgcaattgatacaatgtgttcttcttcactttctgctgttcattttgcatgtgaaagtataaaaaggggagaatccaccctcgctattgccggaggagtgaatttatccttacaccctgataaatatactttgctttcacaaaatcattttgtttcaagcgatgggcgctgcagaagctttggagcgggaggagacggatatgtgccgggagaaggagtcggggccgttcttttgaaatcgctttctgccgcaaaggctgacagggacaggatttacggtgtgattaagggaacatctgtaaatcacggcggaaaaacaaacggatacactgtgccaaatccgggcgagcaggcaaacgtcatcagtgaaactcttgataaggcggggattgatgcagacagcataagttatattgaagcgcatggcaccgggacatctttgggagacccgattgaaatttcaggattaaccaaagctttgcacagctcgaaaagcgattatcgttgtgcaattggttcggttaagtcaaatatcggacacctagaggctgcggcgggaattgcttctattacaaaagtgctgatgcaaatgaagtataaacagcttgctccttcccttcattccgatcacttaaatcctaatattgattttgaggaaacaccgttttacgtgcagtctgaactgaccgattgggagacgccgcaaaatcaagccagaaggtcaggcatcagttctttcggcgctggaggatctaatgcccacattatcatcgaagagtataagaatgaagaaaagatggaaacggtacagagcaacaagacgcaaattattctgctttctgccaaaaatgaagaacggctcagactcttgattgatgcatatataaaagaactcgagccaaaaacgtcactagctgatgctgcgtacacctcgcagaccgggagaaacgctatggaagagcggctcgctgttgaggttagcagcattgacgaccttcgcaataagctgacgatgtatttgcggtcagatcataagttaaacggtttatataggggaaaggcccgccgaggctctggtcaaaaggatgccatgtcagccgctcactttaatagtgcaagagaaatggccattcactgggtgaacggaggagatgttcaatgggaagagatgtacacttccgaattgccgaagcttatctctcttcctgcatatccttttgaacggaacagatattgggtgcctgccgcaaaagcagcacagaaacagaaaaaaacaggcgtaccgcagagtctgccccatgcaccgactgacttatcatttgatgtattaaaaaaatcgtggaaaaaacaaaaggctgcgccttccgcttttacgaaaggacaggtgatgatcctggctaatagtgaaagtgagcggcttgcattcgaattgtttgattcagaccctatgattgaatccgctgtcatttgcgcagataactgggatcattcggatggggaagccaaaaaaacggctctagcagtcatagaagaaaatccggaaatcatcggcatgattgacctgtcagatttccggagtgatcaaaacggggcacgcaccggcacaatcgggaagctgacactgctgcaggaaatcataaagacacataaacagcttttcgttttacatgtgaccagaggactgcagacatttctgaatgacaagccgtcgttagccggagccgaaacagccggactatataaaatgctgagtgcggagtatcaaaagataaaatcaaaaacaatagatgtagacggacatgtcgggactgcggcggaattgagacagataatcacagatgaagcttgcgctgacgggctgtatagtgaaatctgctaccggaacggtgaacgttatattccatacgtcgagaaattacatgcagcggaaataaaccggaaactatccggtctgccagtatgccgtacggatcaaaccctggttattacagggggaacaagagggatcggagcagaacttgccagacattatgccggcaagggagtcaaaaaacttgtgttgatgggagtaaccgaccttccggaatctgataaaatagccggcatgttaaaagacaccgatgaaaagtcacctctttattcgaaattacaactgctgcatgagttggatcaaaagggagttcaagtagaagtgtattccgggccgctcacggaaaaagaaacattacaacgcttcttttcagaggtgagactgaagttcggcaaaatcggcggggtgattcattgcgctggtgcagccaatcattcgaatccggcttttatccataaatctgataaagaaataagagaagtatttgagccaaaggttcaagggatgcaggtacttcatgacatttttattgatgacgaacttgatttcttcattttgttttcatctgttgcgagcgcttttcctttattaggcgccggaacaagtgactatgccgcggcgaacgcttttatggattactttgcggcgtatcagcatgcagccggcagaacatattatcaatcaattaactggccgagctggaaggacattgggatgggcgaggtgacaagtccatcatatcaggcacttggtttactttcacactcaacagaatcaggtattgccatgctggatgaaatgatgacgataaacggatacccctgccttataccggcaaagacacatccggagaaattcatgctgcagcagctgcttcagacaagaattcaagctgctaaaaataacccggatgctgaggaaaaagtgatttctggtcagggagacaatgaatccattatcaggaagttaatggagatcttttccgcggagctgaaaataccttacgggaatttagatcaggatacgtcttttgcggattacggagttgattcaatcttactggttcagcttgtcaaaaaagcggaagatgtatttcaaataaaaattgaaccttcagcttttctggagtatccgagtttttcagaactgggcgtctatttgaacgagttatttgcaagtgaggggatcagtcctcaaattgattcggaaaacattgaggttcggaaaaaagagcaacatataaatcaaaatgcttccgaaatacgggacaacggatcacaaatacaacaaaccagtctgaaccaaatcgctattatcggaatgggctgtgagtttccggatgctccggatacagaaacgttctggacaaatttgaagaaaggacaaaatagtgtccgcgaagtcccggcgtcgcgatgggatatttcttcatactactctgacacctatgaaaagggaaaaagtatcagtaagtggggcggatttcttcaagatattgagtctttcgatcccgcgttttttaatatgaacaaaagtgaggcatcagagcttgatccgttaatcaaaaaatgccttgaggtcagcgtccagacattgagagacggcggctatacaaaagaagaagtatcaaacaaagaagtcggcgtcttcatcggttcgcggaccgggacgtttatgtccaaaataggttccccttcaaaaaatacgatcgtgggtataggacaaaatttcataggcgcgcatatctcacacttttttaatctgaaaggaccgaatctggttgtagacacggcttgttcttcttcattggtcagcgtccatctcgcttgtcaaagcctgatgtcaaaagagtcagatatggcgattgcgggcggagttgacattttgctggatcaaaagccttacgtcatgctgagtgaggctcgggcgctttcacctgaaggaaaatgtcatacatttgatgagaaggcagatggatttgtaccgggagagggatgcggcgcagtccttttgaaaagacttgatgacgcccttgccgaaggtgacagaatttacgcggtaattgactcatccgcggttaataatgacggacagacaatgggaatgacaacacctaatccgaaagcgcaaagcgcagtgataaaaaaagccctgaaaaaaggcggaattgatgcagatactctcagttatgtcgagacgcatggcaccggtacgatgataggagatccgattgaattaaaagcgctgactgaagtgttccgggaggttacggaagaaacgcaattttgcggagtaggcagcgtaaaaacgaatttcggacatttaatgagcgcagcggggatagcgagtattataaaggttgccttatccataaaaaatcagatgctcccgccgacattacattgtaaaacgccaaatccgcgttttaaatttgatcagtcgccattctttccgaacacgtctttaaaagaatggcgtcccagaaaaggggttttgagagccggaatcagttcttttggattcgggggcacgaacgcacatatgatattgagcgacagccatctcacattaggatatggagagacaaaaagacacccgctttctccggttatattcaataaggaacaatgctggatcgacaatggagaaactccagaaaaggaagagtcagaattgctgattcctttacttgatttcaaagaattataaagaaaagaaaaggaatgagacagttggccagtaatcaaaactatcagttcacattaacaattaaacatacggactatattgtcagggatcaccgggtgcatggcacccggattatacccggtgtcacatttttagatatgatataccgtatggcgctgagcaaaggtttgcctattgaagaactcgagtgtcagaatattttgtatttggaacctgtagcaacatcggatacctttgacagagaaatccgcatccgttttcagggattggaacagggatgggaaattcaggcgaagagcagaaaggtaaaagatgactgcattctggatgaaagctgggatgagaatatgacctgcaggctcatgcagaaattcccggaaagcatgagttcaatccatatcgatgaaatcaaacatgcctccgtccgtgaagccgatatggagatatgttatgactatttaaaaaaggttgatatagagcattttgaatttatgaagagtttggggaaggtttatgcgtctgaccattctgtacttgcagagttgacgctcagccaaattgccaatcaatatactggctattttcaattgcatcccacttttcttgatgcgtctaccatcatatcgatcctttatcaggcatgtcccgaatattttacacaaggatctccggcaagccggatgaaaacgtatattcccattcatattgaatctttccgtatgaggaagcgcctggaagacaggtgttatgtgtacatagagaagcaagaccaacatcatgattcaggggatgtcatccaagtaagttacggtttgtacgatgcacacggggggatgatcgcttattttacgcggctgtctgtgaaacatatccgctcaaaagatttaattgaaaacctgaagcagactcgtttggaaactgaagcggcttctcagccaaaagacagcctgatcagaaaagattcaatcataaatcgaagcgaaagcatcgagacacaccttaaagaattaatatccggggtttcaaatatagatctgcgtgacataaggacagacattggtttttatgaacagggcctggattcagcttctttgcttgccattgtcaaagaacttgaaaacaaaacaggggaacagctgtatcctacactcctgtttgagcagaaaacgatccgggaactcgccgcgtatattaaagaaaatcaaaaaatgtccagttatttcttaacgcgaaatcaaccggctgaaaagcctgacatgaaagaaagtaagaacgaaaatctttccgctcttataacagaaggagacattcagcagctgatcgcagatatcaaagggactgctcctgaaacactctctgttgtaaaaggtttttatgaacaaggcctcgattccgtaacacttatgcaagccgtaaaggcattggaagagaaaacaggcagggaactgtaccctactttattatttgagtatccgacgattcaaaaacttgcaaattattttgcagagagcggcgaaaagacttccgttgaaaaagaccgccctcttcatcatggagagaatcatacggctctgacctatttaacgccgcattggagacaaaaggctgccgcttgggacccgaattgcggaaataaaaagaaaagaacatgcctgctgtttcaatatgacagagagctttttcattttatgcgggaaaatgctgaaaatggattcgaaaatacacagatcattctcgttttatcagggaatcgtttctcctatcacggagacggtgtttatgagatagatcacagggaggaagctcactttgacaggcttgcagctgatctgaaaaaaagggggcaaatgcccgacaccgtggtttacgggtggccggaagggtcatttgccggcccggaaaaaataagtgaacagctttctaagggggcttacccgctattctttttcagccgggcattgatgcgcagcaaggcggaaaaaaaggttgtatcgcttttcctttatccggcggaccataaaaatgatcagccgctttacgcttcagtccatggcgcagggcagtctattttgcttgagaacccgaaactggcccttaagacaatcgggatatcagtttcagacaagtcatcgttgccggaacttacagctgaaatcatcagagtcgaatctacggaagcgcatccgggagaaaccgatctttattatgaaagaaatgtgcgctgggtccgagccttacgggaagcggaactgtctcaaaactcaggtttctcctttaaagaaaacggagtatacatgattacaggaggggccggcggcttaggccttatatttgcagaacatatcgcagcccaaacgaaagccaatattattttagcgggccgttctgaacttacggaagacaaaaagaacaaaatcagccgaatgaaagcaggcggttcttcggttcaatatataagaggtgatttttcagatagccgcgatgcagagcgaatcataaaaaccattaaaaggcaattcggagaaatcaacggtgtgatacacagtgccggtgtgacgcacgacgctttattgattcaaaaatcaaaagatgaaattcaggaagtgatcgctccgaaaataaatgggacggtcttattggacagcttgctgcaaaccgaacctttggacttctttgtgatgttttcatcaagcagctcgatgtacgggaatatcggacagacggattacgcattggccaaccgcttcattgatcttttcgctgagtggcgtgaaggaatgaggcggaaaaaagaacgctccggcgtctcagtagccatcggctggccgctatgggaagacggcggcatgaaagtggataaacaaactgaaaaatggatgaaacaaaaaatcggtatggttcctcttagtaaaaccaatgggatcaaagcttttcaagattcactctctctgaacgcatcacagctgatcgtgtttgaaggtgacaaagaaaaattgaaatctgcacttcaagataccttcatggaggatgaaaaccgtgagatccaaataaatgaaacagctgatacaaggcatgaggacattgccattatcggattaagcggaaagtatccgatggctgaagatttacctgaattttgggagaatttaaagagcggaaaagattgtattacagaagtcccgcctgaccgctggaatatggatgatttcttcagcgaagacagagatatgaaagggaagtcttacagcaagtggggaggttttatcagcggagccgatcaatttgatccgcttttctttcatatttccccaagggaagcagaacttatggatccccaggaaaggctctttttagaaacggccaaaaattgttttgaagactcagggtacccgagaaacatgctggaaaagatgaaagtcggtgtatttgtcggtgcaatgtggggccaatatcaactatttgaaggggaagaaaatggagtggctttctcgccggcgtccgtctattcttcaattgccaatcgggtgtcttattattttcatttaaaaggtccgagtttggctctggatacaatgtgctcttcatcactgacctctattcattacgcatgccaaagcatacattgcggagagagcgatatggcattagccggcggagtgaatttgtcaatacatccgaataaatataagttcctcagtatgggacagtttctatcaagtgacggcagatgccggagttttggaaaagacggaagcggttatgttcccggtgagggagtcggagccgtattgttaaaaccattgaaaaaagcaatagaagatcaagatcaaatatacggtgtgattaagggaagcgccgttaaccacggaggaaaggcgagcggatattccataccgaatccggatgcgcaggcggaggtcatttcagaagcgcttcgtaaagctgacattgatccgaacaccgtcaattatattgaagcgcatggaacagggacgtcattaggcgatccgattgaaattcaaggactgaaagattcctatcaattgaaccatccttgcgccatcggttcggtgaaatcaaatatcggacatttagaatctgcggcaggaatcgctgcggtaacgaaagtgcttctccaaatgaagaataagcagcttgttccttctctgcactccgatattgttaatccgtttatagattttgatcaggttccttttcaagtgcagcggaaagcggctgaatggaatattccgcaaaacagcaatgctgttcaccctttgagagccggggtaagcgcttttggggcaggagggacaaacgcgcatcttatattggaagcgtatgagccgccaaaagcttttgatcatcaaagcggccgagtgatctttgttttatcggctcaagacaaacaacggctgataaaatatgcaaaggttatggctgattttctatcagaaaatgaatcgaaggataacaatcataaactgcgtcttcaggatattgcctatacacttcagacgggacgcgatcatatggaagaacggctggcgatagtggcagattccgggcaggtcattgctgaagagctttcagcttatagcaggggtgaaaaaagcagcttgagccataccggtcatacattcgaatcagaagttcacaatgaaatgcctcacgtttgttcagattacgccgaagcagcatccaaatgggtaaatggaagaaagatagattgggagacttttgaggtgaatcggaatgctcgcaggatttctattccgggacaaccgctgatcaaacagcggtattggatagcggaaaaaggggacgcacttgtttcagcggatgtgagtaagccgggtcaccctttcttggggagtaacacgtccgattttaatcagttcagtttcacgaaaaaaatcagccgtaatcatccgtttgcactaagtctgtctgaaggaaacgtgtcctttttcccttatgcatctttggctgaaatggctatcgtcaatgcagcggaggcatttggacaaccagttcatacattaactgatttattgtggaccgaaagcatgaacggaatgactgatatacgggaactgatgattacgctgacgcctgagcgcgactttgcgcgatttgacatatatgcaaacacaaaaaatgagaataaagtacgtcttgccaggggaaatgcgcatattgttaagcctgaaagcggtatgcttcctgaagcgcttgatattgctgaagtcaaatcagaaatgactgaacatcctgctgaatcgccttttgtcattgaatcagcgaaaaacagtgacggaatgctgtcgtttcattcattgccggatgagctttatgcaaaaagagagaattttacgatctctcctgaagcgcttgagtccgcgattcaagccagtgcgttttttgtcagcggagaaaccttcccggaattgatcggactgggagcggcggatgtctatcagcctctcgctcaaaatttttatgtctatactcaaaaagagaaccggcagaacagccgtgatgtaacgtgtcatatgacatttacagatggaaacggaaacattctggcagagtgcagagatgtgagattcagatatggtcatgaaaaagacactgttcagacggacgatgaactcattcgtctcctgcgtcaattggaaaccaatgatattgatcagaaggctgtattgaaacaattaatgggggaagaatgatgaacggaaaacgtgaacaaatcagcgatattcttgatctgattcaaacaggacaaatgtcggctgacgaaggctatgcccgtgtgacatccattcagaatcaaaaatcacgggcatcgaaccatccgcttttatattacaagccggaatggacagaatcgttcattccgagtaagaagagcgtgtccttgacgggattgctcctgatttttgcagaaaatgaacggcaaatacaagaattgagcggtttgtttaaggactgcactctcttgtttgtcatccgcggaaaagaatttgctgttttacatgatgatacgatttgtatgaaccacgtgaaaaaagacgattatctaaagctgttccgatacattcatgatcattatcagccgcccgaaaagattcttcacttgtggtctgattctcaggctgacatgagtaagggaggtatacagaaacaattggaaaacggattgttttctcttctgtatattacacaggcgctgattgaactaaaatggaaaaagatactaaaactgacgcatgtttttcaaactgagaataaagaacaactgccgctgcatcatgctctcggcggattggtgaaaaccgttcaccaggaacaccccaattttcactatcagattatcaatatcactctttcagagggtgcgggagccgctcttccagcaatagctgatatatatcagagagagtgtgacgaaaaacgggatatccattttgaagtgcgctatgaaaacggcagacgttttacgaaaagctataataaagccggctcattcgatttaacccagccgctgaaacatcatgggaattatctgattacaggaggcctgggcggtctcggttatatactggcaaaacatctgtcggaaaaatggaaagcgaatctcatattgacagggcgctctgatttaactgaagagcagaaaaaaaagatcgaatatttaagaagctcaggttcaacaattgaatacatccgatctgatgtttcaaaacaaagtgatgctgaacggatgtttgcttttgcaaaagagcagttcggcatcttacatggagtatttcacagtgccggcgtactccgtgactcttttatcttaagaaagacaaaagaagaaattgatcaagtcacaggttcgaaagtttatggcgcgctgtggctggcggaagaaatcaaaaaaatgaaagttgaattacttgtcttgttttcatccacatcggcagtcttcggctcagccggccaatgtgactatgctttcgccaatgcctttctggatcagtatgcagcagttatgaccgcgacagagtctgccgaaagggtagtgtcagtcaattggccgctatggacttccggcgggatgaatattgacgatgaaggagtatcctacatgaaacaggaactcggtcttgacccgttagatgacggtgacggaatacaggctctggagaacagcttgtgtcaatcatctgaacagctgattgccctgaaaggccgtaaagaaaagattgaggatgtgctgaagcgtgccggcacaatcagctttcattcagagcagcaggaagatgccgatttgcaaaacgatgaattaagacaaaatataatcagttatctgaaaaatataatgtcagaggaattgaaattaccggcctcactcatagatgaaaaacaatatctggagaaatacggcattgattcagtgatgatcatgcgtctgactaaaaagctggagcaaagtatcggcagattgtcgaaaacattattttttgagtatcattcaatatcgcagttagccgaatatttcctgagtcatcacagcgaacgaatgatgaaactgctgaacccggccggcacatctgaacttgtttcatatcaaaaaaagcaaaaaagaaaaccagtggaaacaaaagcgccggtacgctctgaaggagaagattcaaaagagcacattgcggccgatcccctttctgctgatatagcgattatcggtgtcagcggcagatacccgggtgcggaaaacatcagggagttccagaatgtgctgatgaatggacgggattgcgtaagcgaaattcccgatgaccggaaggaaatgctggagggaagctgctataagtggggaggttttctgaaaaatccagaccggtttgatcctttatttttccggatatcaccgaaagaagcggcttttcttgatcctcaagaacgcctctttttagagacagtgtacaataccatagaggatgcgggttataaaccttcagatctgacccgcaaaaaggtcggagtatttgcaggcgtcacatatggaagctatcaatttttcggcgttgaagaatcacttaaaggaaatgaactggccgtcgggtctccattttctgcaatagcaaacagaatatcatatttctttaactttaaggggccgagtatggcggttgatacaatgtgttcatcctctcttaacgccattcacttagcctgtgaaagtatacgaagaggagaaagcacacttgctgttgcgggcggggtcaatcttacgcttcatccgaataaatatacattattaaatcaaagccgcttctttgcaagtgatggccggtgccgtacattcggcgagggcggtgacggttatgtaccgggagaaggagtgggatccgtacttttaaagccggcggcggaagcggtaagggacggagatcatatttatgcgctgattaaagcgacagcggtcaatcacggagggagaacaaacggttttacggttcctaatccaaatggtcagtctgaactgatacaggacgcgcttcagaaagcttgtattgaccctcgtacaattagttatattgaagctcacggaacgggaacttctctgggagacccgattgagatcaccggattaacaaaagcgtttcgggaatttacggagcacactcaatattgttcaatcggttctgtcaaatcaaatatcggccatcttgaggccgcagcgggaattgccggtttgacaaaggttcttttgcaaatgaaactgaaaaaactgtttccctccatacatgcggagacgttgaatccaaatattgattttaaagcatctcccttttatgtacagcggtcattgcaagactggaagaaaccgaaactgcaggaaaacggaaaaacagtaactgttccgagaagagcggggatcagctcattcggagccggaggaacgaatgttcatatcattatagaagaatatgaagaaacaaacgtctcaacagaacatgttgagaacgaaccgcatattgtcctgttatctgccaaagacaatgaacgtcttcttgagtatgccgaaaacatgaaagattttattcaacgttcactaagtcctgaagtaaaggataaacagcctgatatgaaagaaaaggtgtatgaagtactcaaaccgtttgtttcggaattgcttcatatccatccggaagaaattaatattgctgatcacctgagtgaatttggcgtagggcctttggaattaagccggatggcggattttattaacgaaatgtttcatattgaactcacgatgtatgaattaactgattgcgcctccattcaagcggttactgaatacttattgaaggaatatgccggagcgataagaaacatgttcccgaatgaagtgatggaagccggccaatcggaaagcgtcgttttacgggatctggcatacactacacaatcgggcagagaagcgatggaggccagagcggcgattaccggtacctctcttaaagaaatgaaagataaattatttgagttttgccgcggtgacaagcaagttccaggcgtatatgttaatcagcaatcagcagatgcattcgctgaaaaaatgaaggcgttaacggaaggcagagcaggtgaattgtttgtaaagaccattattgagaacggtgaagcggaaaagctggctcaattatgggtttggggggcggatatcgactggaaatccgttcatcaacatttacagcagccgggtaaacggatctcaattccgacttatccgtttgcaaaagaacgttattgggttccgtccaggactgagaaggcagagatccctcagcattcttttcaacatcatttgcaaaaaaaatggagggagaatccgtttgtaaatccatccgaaacaaaagagtacggactgacagtagcatttgtaaatcaagacacagaatcaattgcccgcaccatttgttcggatatagatcaggagaatctgattgtcataaaacatcactcttcatttataaaacactctgatcaaatgtttgagtgttctttattagatgaaaaccacgcatacgacgttatccgtgagatcttctcgggcggtgagcggcaggtcgaaaatatatttgatttctcagatatcggaaaccagagtgacaatcagaacggcatcccatatggtaaattcttatttatacaagaaataattaagcggagtaaaaaggaaacaccattatccattttacaaatcaccaatggcttgcaggtatttaaagcggaaaaaccaaagctgacgggggcggaatcagcggcttttctgaaagccctttctgcggaatacggctttgttcatgtgaaaacaatagatatagacagcatgaaagaaacgcatgagctgaaacaaatctttgagaatgaaagggcgcaatgtaccggagagaatgaagtatgctaccgcagcggcgtcagatatgttccgtattttgaagaagaaagaatccataccggcgggcctgtttcatttcctgcggataaagccatcgtgattaccggcgggacagggggtattggcagagcaatagctgaagatttggtgaaacggggagtgaaaaaactcgtgctgacggggacgcgtccattacctttgcgaagtgaatgggatcatttgctgaaagagggcagacaggacgaaaagacagtcagcaatatcaaactgtttcaaagttttgaagagaaaggtgtcaactatctgtattacagcggttctctcacaaatgaagagaagctgcgttcattctttcaccaagtaagccttgaatttaaagatataagcggtgtcatacactgtgccggactgcacagcggcggaaatccggcctttattcataaaagaatgagtgaatttaagacggtgtacgggccgaaagtcactggacttcagaatttggagcggatttttaataataggccgctggatttctttattctattttcatcaattgctgcacagtcacccaaactgtcgaaaggaatgactgattacgcgtctgcaaacgcatatatggactatttcgcggcttatcattttcaaaaggggagaacgtatttcacgtccatcaattggccgagctggaaagaagtcggaatgggtactgtgacgagtcctttatatgatgaattgggattggactctctttccacacgggaaggactggcgattttgtatcatgcactggagaaaaaatcggccaatatcattcctatcgtgaaaaaaggaacagtgtttcatgcagacagtctcctgaatatcaataaaaccggcaaggcttcatttccagtgcgaagacaggagactcccgacacttttgatcattcagaagggcttgtcagtgaactttctgccgtatttgccgaggaattgagcattccccttgaaaagcttaacccaaatacgaattttcaggaatacggtgtggattctatacttcttgtcagcattatacatcgtatagaagcaatgattcagaaaaaaatcgaccctactgtgcttcttgaacacaacacgattcatggtcttgcggaatatatcggtaagacggcgccgccgttgaaaaaacaaatcgaacagactgattctcaaagcagtaatcagcatgatatgcagtctgtgacgagccgaaatacagaaccgcagacggcttcctctgcaaagatagctgttatcggaatcggatgtaagttccctggagcggctgataaagaggaattttgggacaatctgagaaaagggaagaatcatattaaagaagtacctgattcccggtggaatatagaagaaaattactctccggtgcagcaaaagggaaaaagcatcagcaaatggggaggatttatcaatggaattggcagcttcgatccggagtattttcgcatggaagaggagaaagccatccaaacggacccgctgataagacatttcttagaaacgagtgtacagactgtacgggatgccggttatgaagaaacagaattatcgggaaaaaaagtcggcgtatttgtcggttccagaatgggcggctacggtcacaaactgccgaaagaaagcagcagccacatcgtcgggcttagtcaaaactttattgcttcacacgtgtcgcatttctttaattttcacggtccaagcatggtttctgataccgcttgttcttcttcattagtcagcattcatttagcctgccaaagcataaaaaacggtgattcagagatggcgctggcaggaggggcggatctgcttttggatgaaattccttacctgatgttaacagaaggaggagctctttcgccggacggtcagtgttttacttttgatgaaagggcaaacggctttgtacccggagagggttttggcgctgttctgttaaaaccgctcgagaaagcgaaagcggacggagatcggatatacggtatcattgaagcatcagctattaataacgacggtgcgacaatgggaattacgaccccgaatcctaagcttcaagagcaggttattcaagatgcatttgaaaaagccgatatcactcccggatcagtcagctacgtcgaaactcacggcacaggcacgatgattggagatccgattgagctacaggctctgacaaaagtattccgaagagacacaaacaaaacgcaattttgcggagtaggaagtgtaaaaaccaatatcggacacttattaagcgctgccggagcggcaagtttcattaaagtgattttatcaatatggcataaggaaattccgcctacattgaattgtgaaacgccaaatccccgctttgaatttgaaaagtcgcctttttatccgaatacagagctgagaagctggaaggatggaaaacggagggcgggcatcagcgctttcggttttggcggaacaaacgcccaccttttggtaagcggcctggatgattcatatcatgccgtcagaactccgctgccgcctgccgagtttgtcagaaaagagtactggccggattcaaatcgaaaaaaacaaatcaaacagaataaaaaacggcttcttgaaattattgatgaaacagagtagcacctgctctgtttctttactttgtaaaagaagaaaggttgtcgagttgcatgaggttcagcgtattagtcaaacatgacgattatattgtttcagaccatgtccttcatcaagtgcgtacgatacccggcgtaacgtatctggatttaataacacgatttttagctgagaaagggatatccccccgaagttttgaaatcaaacatgttttattccgtgaacctgttgcgacgtcagtccattttgataaaaaagtcaccttccagtttacggaacaagaaaacggctggcttgttgaaacaacaagcaggaaatgggtcgctgaaaaggcggaaggtgaagcgtcagtcaacttgcaggcggaaatcataagaaaaaatgcgataaacgaaaagacaatttcaatcgaagaattaaagaaaggagccgtccggacttcggatgctgaatccgcctatcgtaatttgcgcaggggcggcctgattcataaagattttatgaaattggaaggtacagtatatgaaggtgaaaattatattctgggagaggtcagtttaagcggactttcaaaagaatatacagatgacttttacatgcatcccgcatttttggatgggtctctcagcttgttgggaatccttacatcagacttgccggatgaaggaacaaatgcgtttatccctatatatattgagacattccgggcactgcataaaacaactgggtcttgttttgtgtatattgataaaaacagtataacgcagccgccttctaaagacattttatatgcggacatagaagtatacaggcctgatggagagcttgctttttattatgagcgattcggtgtgaaaagagtcagaaatgaaaaatcaatacaaaggctggagcattcccaaaaagctaaagaggttggcagcgcaacgaacaataaagaaatgatcagaaataatttgatccaagagatagccggcatgattgaaaaacctgctgaaacagtgaagaatgatatttccttttacgagatgggcttggattctaaacaattattagacttatccaaaaaattagaactgatgttagatacaaagctgtacccgactttattatttgattactccacaatcggtgaattgacggaatatctgcaggagaaatacggagctgacattacagactctatctctgatacagttttgcaccaagacagtcaaaaaacattaacagatgagctgtcatccattattggagaggttacagacacaccgccaaataaagcggacaaacaccaatctttttacgaactgggtcttgactcaaaacagctgctgcatatatcgaaaatgctcgaggaaagattggatacacaattgtatccgacattgctttttgattataacaatattcatgatttagcggcttatttagaagaaaaatatgatgtgcgtaatacaccggctgcagcttttaaagaaaaaacgcaaacgaaagagccgtctgaaaagccgatgcttgaatctttgtatttacaaaaagaatggattgagtcgccattaaagtccggagaagtgtctaaggaaaatactttgattttcgatttcgacagttcattgagtgatgaaatccgcaactacaccggcagtgaaaatgttatttatgcggcagccgccgctgaatatgaaatggtaaatgaaaagcattataaatttaacccggagcagtctgctcattacaccagactgttagatgatatgaaaaagtccggagcgtttccggcgtcaatcattcattacctgtcaaaaaaagcttatactgaagcggcgttagacctgactcacagcttttattcaatcctttatttaagtaaagctttgatccgtcaaaaaacaaaagaaaacatcaacattctgtacgtacatgacaaggatcaatatacaaatccggtttacgccgcgattggaggcttttttaaaacgctgaatgcggagcagccgaatataaagtgtaaaacggttgagatttcttcaagacaaaccattgaaaaagcacctttgcttctcaatgaattaagtgccggacatcatcagactgtgaaatatgacggcaatcaaaaaaggtgggtgacagcatatagagacgcttcgctgcaaacaggacaaaaggccgcaaagtttgcaaaaaacggggtgtatctcatcatcggagggttaagcggcatcggctggattatttcagcgtttctttatgcaaatcacggagccagcgttatcattgccgggcgatcgaaaatgacagcagacatggaagaaaaattagacagcatccgatatgacggggcaagcatttcttatatccaggctgacatgtcagataaacagcaggtcatcaagttagcggaaaaaattcgtgctgattattccgaaatcaacggggtcatttacagtgcaggcgtgttaaaagactctctcattatgaataaaacagacgcggaagctcaagcggtgctgcaatcaaaggtcaatggtgtgattcatttggatgaagcgctcagagatatgcctttagacttttttgttttgttttcttccatctcctcagaaatcggaagtctgggtcaagccgattatgcctacgccaatcgttttctggagcattttgccgagtggagggaatgtatgagaaaggcggggggaagatcaggaaaaaccatcgctgtaaattggcctttctggaaagacggaggcatgtcagttgatcccggcatccaagatattatgaaaagggagtacggacttcacccattagaaaatactgccggaatcaaagcttttgaacactcgcttctcggccaaggccaccagctgatcgtgttatacggagaaaaagaaaaaatacaaaacgatttcaagccgttatccgcccgttcagcaccgcctctggtaagagattcagcgattgcagccgattttgatgcttcgtcaatcgttacggaagctgaaagtcctttccggatactcggcacggcttccaatcgtcatctcgatgattatttgcattattggagcagactgaagaaaggagcccttcagcacaatcaaagcgatgccgcaaaaaaactcatcgctttttaccagacagaagaaacggaaaccgttcattttctggcaaacacagaaaatgcccggcatatggagatattgatgagcggtaagggcgaaacaattttactgatttgcggttttgctaccactgcttacatgtggaaagaacaaatgaaagagtgggcagatcaatttaatgtaattgtcatacacacaccgggttacgggctgagtgaggggagcgccgattttacactgagcgggctggctcagacttttatcgaagtgctgaacgagataggggttgcttggccgatccacattgcggcagcttcttggggaggcatgatagggcagaggatagcctatgaataccctgaaaaagtaaaaacactcattctttccggaagttacaccgaatacgaagaagaccctgaaagcagtgtcgaggaaaaactgaaaaatgattttatagctataggtaaatcgcatgaatatgaaagtttatacagtaatcaattcttaaatgcttctattgaacgttttatgaagatacatcaacaagaaggctattctacaaccggctttttaaaagacattcatacaagaacgcttatccttacgggtgagaaggaaagcgtagttgatcagaaagaaacaaaaaggctgcagaaactgctgagcaatgcagaattaaagaaaattaagggagcggggcatcttccgaacatcacacatccggaagaatttaataaagcggtgtcagaattcatcaagaaatcggtaagtaaaggatgaaaacgatacatacagtacagggggagaaaacaatgaaacaaacaataagcaatccggcatttgatatgaaacaaattaacgctcttaacagccattatcagacgatgatagacaatggagatctgcaatgtgcgagttatatgatgtcaagaggaggtgaggtttttgcagctgagtcgttaggggaatttaccggcggacaaaacgaaaagcaaacatttcagcttgatacaatcagagaaatcggttctttgacaaaagtgtttaccgctgtagccgtcatgcagctcgtcgaaaaaggtttgctcgatctgaaaatgccggtcaagctcattttgcctgcgtttgataaaccgggtttcggagaaattaaaattttgcaccttttgactcatacggcgggattaagttttgagctggatattcaaaaggctgaaggcattgacttaacgaatgaggaagaatggataaactatctcgtcagtacgcctttggagtacggagtggatgaagcgtggaactattccagaaccggttttgttatacttggcatcattatttcaaaagtaacaggcgtatcctacgaacagtatgtaacaaagcatattattgaagcgctcggattagaaagaacgtatttttatgtgcctgatgctttaaaagaagaagtttgtgtgatcaatgaacacgagtgcgtacagctggaaaaaagtcatcacccgtattttccgaataaagcgacaagcggtctgtactcttcgttgcgggatatttggaagttggctgaaatgtttagaaataaaggcagattgaaagataagaagctgcttggaagaaaaacagtcgaggcgatgctgagaaatcaaataaagcccggtcttcctttttacttcttcggagcgcccagagaggaaggcggctttggtttaggcattaatttgtggccggccggcgaccattatttcatgacagaaggcaccttttcacatcttggaatgggttggtgcggcatgttttctgatccagccgaagattttacgtatgtatttttcactccgatttccgagtttcatcctcatgccgtgctgacgccgctgaatatcgtgtgggcgggtattgaataattagacaaaagcatcgttccgtctgttcggcaggcgggacgattgctaactgcccgtttttatcccgcggcatcttttcaaagcccgcccctaagttaaataacttaatttactctttgtaattttttttaattatagtacagtagagcatttttataatacagtttaaagtcttttatagtacagtttggcgcaatatgatcttaagttttataagcggtttcaaaatgaggttataaatgattgacggctttgtttaattactgtaaactatggttgttgatcatattgtactaataaaaaatctttttttattagtacagtttaaacgtccttatctttgcttaagcgctatgtgaatttctgaatgattaattttagaattgcagagcatgataagactgtttttaatacggatggctaaacggtatcctaaccctgttaaatcaaaagaagaggtggtttaaaaaatggctgcaaagacaaaaacttcaattgttgatagcaaaaaacaatttgatgctattcataagcagtttgaaacgttccaaattttaaatgctgaaggagaagtcgtaaataaagacgcaatgcctgatctttcagatgatcagttaaaggaattaatgagaagaatggtgtatatccgcattttagaccagcgttcaatttctctttcccgtcaaggacgtttaggtttctatgcaccgacagcgggccaggaagcttctcaaattgcatcacacttcgcgcttgaacaggacgactttatccttccgggttatcgtgacgttcctcagctgatttggcacgggcttcctttacatcaggcattcctgttctcaagaggccattttaaaggtaatcagatgcctgagggagtaaatgctttatcacctcaaattattatcggtgctcaaattattcaaaccgcaggtgtagctttaggtcttaaaaagcgcggtaaaaaagcggtggctattacttacactggtgacggcggagcttctcaaggtgacttctatgaaggaatgaactttgccggagcatttaaagcgccagcgatcttcgttgttcagaataaccgctatgcgatttcaactcctgtagaaaagcaatcatccgcacagacaattgcccaaaaagcagttgccgtcggtattacaggtgttcaagtagacggaatggatgcacttgccgtttacgctgcaaccgcagaagcacgccagcgcgcaattaacggtgaaggtccgactctgatcgaaactcttacattccgttacggacctcatacaatgtccggtgacgatccgactaaataccgtacgaaagaaatagaaaatgaatgggagcaaaaagacccgctcgtacgtttccgcaagttcttggaaaacaaaggactatggtctgaagaagaagagaacaaagtgattgaacaggccaaagaagaaatcaaacaagctatcaaaaaggctgacggcgaatcaaaaccgaaagtaacagagctgattgagaatatgtttgaagagccgacgttcaacttaaaagaacaacttgaaatttacaaagcgaaggagtcgaagtaagccatggcgcaaatgacaatgattcaagcgatcactgatgcgttacgcacagaactgaaaaacaatgaaaacgttctgcttttcggggaagatgtaggcgttgccggaggcgtattccgtgcaactgaaggccttcaaaaagaattcggtgaggaccgcgtatttgacacgccgcttgctgaatccggtatcggcggtctcgctctcggtttaggcctgcaagattaccgtcctgttatggaaatccaattcttcggattcgtatatgaagtaatggattcaatctcaggacaaatggctcgtctccgctaccgttccggcggacgctggacttctccggtgacaatccgttctccattcggcggaggggttcatacacctgaacttcacgctgacagtttggaaggccttatcgctcagcagccgggtattaaagttgttatcccttccactccttacgatgcaaaaggactgctgattgcctctatcagagacaatgatccggttgttttcttagagcatatgaaactttaccgttctttccgtcaggaagttcctgaggaggaatacacaatcgagcttggcaaagctgatgtgaaacgcgaaggtactgacctttctatcatcacatacggcgcgatggttcatgagtcgcttaaggctgctgaagagcttgaaaaagaaggcgtttctgctgaagttatcgaccttcgcactgtaagtccgcttgatattgatacgattattgcttctgttgaaaaaacaggccgcgcaattgtcgtgcaagaagctcaaaaacaagccggcatcgctgccaacgttgtagctgaaatcaatgaccgcgcgattctgagcctggaagctccggttctgcgtgttgcggcgcctgatacagtatttcctttctcgcttgctgagagcgtatggcttccaaaccataaagacgttcttgaaactgcgaaaaaagttcttgaattttaatcaggcatcataaaagacggtaaagagagtccttttctctatatgaaggagtctgtttactaggttcaatgcttgcgaatgcataactaaaatttgcttaatcaactaggaggtcgaaaactgtggcatttgaatttaaacttccggatatcggggaaggtatccacgaaggcgaaatcgtaaaatggtttgttaagccgaacgacgaggtagaagaagacgatgttctggctgaagtgcaaaatgataaagcagtggtagaaattccttcacctgttaaaggaaaagtattagaattaaaagttgaagagggaacagttgcaactgttggacaaacgattattacgtttgacgcacctggttacgaagatcttcaatttaaaggaagccatgattcaggagatgcgaaaactgaagctcaagttcagtcgtctgctgaagcagggcaggatatcgctaaagaagagactcctaaagagcctgcaaaagaaaccggcgcaggacagcaggaccaagcggaagctgatccgaacaaacgcgtcatcgcgatgccttccgtacgcaaatatgcccgtgaaaaaggcgtggatatccgtaaagtaacaggttcaggcaataacggacgtgttgtaaaagaagatatcgacagctttgcaaatggaggagcggctcaagaagcggcaccgcaagaaacagctgcacctcaggaaacagctaaacctgcagcggctcaggctcctgaaggcgaattccctgaaacacgcgaaaaaatgagcggtatccgtaaagcgatcgcgaaagcaatggtgaactctaagcatactgcaccgcacgtaactcttatggatgaagttgacgtaacaaatcttgttgctcaccgcaaacagttcaaacaagttgctgctgatcaaggcatcaagctgacttatctgccttacgtcgtcaaagcattaacatccgctttgaaaaaattccctgttttaaacacatctattgatgataaaacagatgaagtgatccaaaaacattactttaacatcggaattgcagcggataccgaaaaaggcctgcttgtgccggtagtgaaaaatgccgaccgtaaagccgttttcgaaatctctgatgaaatcaacagccttgctacaaaagcgcgtgaaggcaagcttgcacctgcggaaatgaaaggcgcttcttgcacgatcacaaatatcggttctgccggaggccaatggttcacaccggttatcaaccacccagaggttgcgattctcggtatcggccgtattgctgaaaaagcgatcgtccgtgacggtgaaattgtagctgctcctgtcttagctctttctctcagctttgaccaccgtatgattgacggagcaactgcacaaaatgcgttaaaccacatcaagcgtttactgaacgatccacaacttattttaatggaggcgtaatgttatggtagtaggagatttccctattgaaacagatactcttgtgattggtgcgggacccggcggctatgtagctgccatccgcgctgctcagcttggacaaaaagtaacagtcgttgaaaaagcaactcttggaggcgtttgtctgaacgtcggctgtattccttcaaaagcgctcatcaatgcaggccatcgttacgagaatgcaaaacattcagatgacatgggaatcactgctgagaacgtaacggttgactttacaaaagtccaagaatggaaagcttctgttgtaaataagcttaccggcggtgttgcaggtcttttaaaaggaaataaagtggacgttataaaaggggaagcttatttcgtagacagcaactctgtccgcgtaatggatgagaactctgcgcaaacatacacatttaaaaacgcaatcattgctaccggttctcgccctatcgaattgccaaacttcaaatatagcgaacgcgttctgaactctacaggcgcacttgcgcttaaagaaattccgaaaaagctcgttgttatcggcggcggatatatcggtactgagcttggaacagcgtatgcgaacttcggaactgaattggttattttagaaggcggagatgaaattcttcctggcttcgaaaaacaaatgagttctctcgttacccgcagactgaagaaaaaaggcaacgttgaaatccatacaagcgctatggctaaaggcgttgaagaaagacctgacggcgtaacagttacattcgaagtaaaaggcgaagaaaaaacggttgatgctgattacgtattaatcactgtcggacgccgtccgaacactgacgagctcggccttgagcaagtcggtatcgaaatgactgaccgcggtgtcattaaaacagacaagcagtgccgcacaaacgtaccgaacatttacgcaatcggtgacatcattgacggacctccattggctcacaaagcgtcttacgaaggtaaaatcgctgcggaagctatttcaggagagccggctgaaatcgattacctcggtattccggcggttgtattctctgagcctgaactggcttctgtcggttacactgaagcacaggcgaaagaagaaggcattgaagtcgttgcagctaagttcccgtttgcagcaaacggacgtgcgctgtctcttaacgaaactgacggcttcatgaagctgatcactcgtaaagaagacggtcttgtaatcggtgcgcaaattgccggcgcaagcgcttctgacatgatttctgaattgagcctggcgatcgaaggcggaatgactgctgaagatatcgcaatgacaattcacgctcacccgacattgggcgaaatcactatggaagctgccgaagtagcaatcggaagcccgatccatatcgtaaaataataatgtaacaaagaaacagcccccgtttgtaaaagcgggggctgtttttattgtgcaagcacatgctgcataggtttgatgatatcctcttttttctttacggatccctcaatcttcatgaccacatgccgatgattgacaaccatcagcgcagggaacgtgttgatttcctcttcccatccctttctgttgtcataaaccttcatttgatcgacatgatggggatatttcttttctaaatcaaggatcgcatcgtaataaggcacttctttatctatatgattttcatcggaaaaaaacaagatttgagtgtgatgaatgctgtcgatccggttttttttgaatggactgacagtagaaaccgaacagcttgacagaacgaacagcatcaaaaaaaagggaatcaccgtacggtagcgcatctatcttactcctctgttttatataatatattggttcatccatttataaggactatatcaagtgtatcacgagaggtgaaaaacctaaggcttgttactgaattgttatataattgaaaccgtttttaatgaagaaataatacgtgtgacaacttgcgcagccgatgtgtaaaaaaggcacattgtttttcgtgagagcgctgttttttcgttatactgggggcaaaaccatatcaggagggattgtcatgtataaagccgctgcagccgtcgtatgtatgtgcttactcgccggctgccaatcaaatgaaaaaatgcaaacaaacaaaccccattctcaagccgcggccaatcatgccaaacgggaaaaccaccatacaaaagaggaaaaacagaaaaaacagaaggcggagccccgttactatatcaatcctaaaaccttttctgtggaaaaaatggatgaacagaaagagaaaaaaccgatcgcattggtaacgatcgatgacgcgcctgatcagcatgccgctgagattgcggacaaactgcatgatctcaatgcgtcagcgatcttttttgtaaacggacattttttgaaaaaagatgaaaataagaaagcgcttaagcatattcatgagttaggttttatgatcggaaatcatacaatgactcatcaaaacttaaaagatctttccgaacaaaaacaacgggaagaaatcattggcgtcaataaagcggttgaaaaggtaataggagagaaacccgcatttttcagggcgcctttcggaagcaatacggactacagtgacagacttataaaaaaagaaggcatggtgaaaatgaactggaccttcgggtatgattgggatcagaaatatcaatccaaaaaagcgcttaccgatatcacactgagcagtccttatctgcgggacggggccaacatattgatgcatgactggaaatggacggcagaagccatgccggacattgtaaaaggattgcgtaataaaggatatactgtgattgaccctcgagctataaaaagaccgtaaaaaataaatgtgttatacaatttatcagttgacatattaaatgtgacataataatataataacaacaagtgaaaattaagcgttttcaaattctgagaaatggggaatgacagatgggtacaattgtttgccaagactgtaacgaagcgattcattactttgaggatgagaaggtcacgacgttatacggaacatgctgcggacaatgccagtgtcatcttgaagaagaataaaaagcgtaaaaaggcccgaaacaatttcgtttcgggcttctttatatttattggatggctttttgctctttgatgactctgatcatttcaagcgttgcatcttcgggaccctgcacaggaaggccggcgtccaagtttttaaaaatgtagctgatattttcttcagtaataatctcacccggaataaagatcggaattcccggcgggtacaccatgacaaactctgcgatgatccgtcccgcggattcttttaacggaatgacttccgtatttgcgtaaaacgcgtctcttggcgtcatcgctaacagaggaatttcaggaagcagaacttcggtttgctgatgagcatagtcattggcggaagcctgctttgaaatgtctgtaagcgcgcttacaagacggtcggcatctcctgctctgtctccgggggtgaaaatacataaaatattatacaaatcggacagctcgacttcgatattatatgattcgcggagccatttttcaacgtcatgacccgtcaggccgaggtttttgaccgaaatgattaatttagtcggatcataactgaaggcagctttagaccctgtgatttcttcgccgacacagcggatgccttcaatttgattgaggcgttcccgtgtctgatccgccagcagaatcgtatcttcaagaagatcgcggccttctgcagcgaggcgttttcttgcgacatccagtgaagcgagaagcagataggatgttgacgttgtcgtcagcatgcttaaaatcgactgtactctttctttggaaacaaggccttctctcacatttaaaatggaactctgcgtcagggagcctcccaatttgtgcacgcttgtggctgccatatcagcgcccgcctgcatggcggacagaggaagcttatcatgaaaatgaatatgcacgccgtgcgcttcatcgacaagcacaggcacattgaaagaatgcgcgagctttacaatgctgctcaagtcagctgccacaccgaagtacgtcggatttatgacaagcaggccttttgcatcagggtgctccgtcaaagcccgctcggcggactcaagcgtaatgccgtgagaaattccgagctcatcgtcaatttccgggtgtataaaaatcggcaccgctccggaaaatacaatggccgacataatggatttatgaacgtttctcgggatgatgattttatctccgggtccgcatacggccatgaccatcgtcataatggcgccgctcgtcccttgtacggaaaagaaggtatggtctgcgccgaatgctcgagcggccagatcctgggcttctttaattatgccctttggcgcatgtaaatcatccagaggttcgatattaattaaatctatgcttaacgcgttttctccgataaattgtctgaattccgggtccattcccgcgccttttttatggcccggaatgtggaattggacaggctgtctgtccgcgtgctttttcagtccgctgtacaggggtgtttcatgttgcggcaattgttttcccacctttatcataatacctacggattagtttgtattacattcagttttattacccgttttttaaacgtaaaacaaatgaattatattatgaacttgaaagaaagtaaagaacaatttatgatctatggaagatgcttattttgagcatgattataaaggagtgaagacatttggaatatcaatatccgatgaatgaggactggacgacagaggaggccgtggatgtcattgctttttttcagcaggtggaaaacgcctatgaaaaaggagctgaccgagacagacttctgaatgcgtaccgccgctttaaagaaatcgttcccgggaaagcggaagaaaagaaaatctgcagccaatttgaagctgacagcacctattccccgtatcggactgtgaaacaggcgaaacaatcagatcaagcgattatcaaaatgtagacaaagcgagccggcaatcggcccgctttttatgttatgagactttctgagtcagtgtgtataaaaaggaaagcttcctaaaagcgtcttcaatggtttgcaggaattcattgttgttcatgttgatcacgtcttctttttgcagctgaatgccgcacaaaagctctgcttttttcactgtctgcaggcgttcaaataatgttttcagctgctcctgatccatgtcggactgcttgtacgcacctggcttcgtatgatccggcgaccatacaaaatgaccgggaatctgttttgtgatgtcctcctgcttcgcttccagcaatctgccgtattcctcttttatcggagattcataaatgatggcaaaccatacaaacatatgggtgtcccataaaccgatctgaaagtgagggagtttcttatacccgcgtttgctgttggcaaaggcaacccagctgtcagccggcgggttgacagatcttctcgcgtgcttggcgacatgcgggaacatttcatctcctgtcaatgctgacaatgtcggtgcgaaatgctctcctaacaaggtcagcttcggacggacttgttcttttaacacctccatgcgcggatctaaaccttctattgtaaatgtatcgaagtcttcttttgtaaaacgcatctgagtcatctttttcctccttatcgtaagtattcatattttaccacagccgccgccggccgcaaaaacattgagaacgtttgagccgagaggattggggtaaaaaacgaataggtaaacacacaattttaagaatgttgttacagccgaatataagtttccatacgatataagaagtatcattaataaattggaaaaatgggatgcttttttaacaaatgatctctggaaggggcgaaagacaatgaggcaagtggtgaaggaaggattcagggaggaaaaaaataaccgtgtagctgtctggagactagaggttgattatgaattggcaaccctgtatgaggccatgcaaaaagagaatgaagatcaaatcgatctcagcaaaagaaaactggaacgtctcagaaaagaatggattcggcttaacggataaagaatagtaaaaacgaaccgcaggaaatggttcgtttttacgtgagaaggcatttttttcattttccttgctttttcatcgcctttatcagtatgctatagaataagctatacatagaaaagaggtacacggtatgacaaattggacggaaattgatgatatcgcaaaaaaatgggtaaaagaagccggaacgagaatcagacaatccatgcaggaaagcttgacgattgaaacaaaatcaaatccgaatgatttagtcacaaatattgataaagagacggaacgctttttcattgaccgtatacaaggaacttttcccggacaccggattctcggagaagaagggcagggggataaactccgctcccttgacggaattgtctggatcattgatccgattgacggaacgatgaattttgtccatcaaaagcggcatttcgcgatctccatcggcatctttgaagacggaaaaggcaaaatcggcttaatttatgatgtgatgcaggacgaactgtatcacgcattcagcggaaaaggggcttatctgaacaatacgccgcttgctcctttaaaagaagcttccattgaagaagccattattgcaatcaatgccacatgggtgacggaaaacagaaggattgacccgagtattttggcgccgctcgtaaaacgggtcagaggaacgcgttcctacggttcggcggcacttgagctggccagtgttgcggccggccggattgacgcattcattacgatgaggctcgcgccgtgggattacgctgccggctgcgtgctgctgaacgaagtcgggggcatttacacgaccacagacggcgaaccgtttacgtttttagacaaccacagcgtgcttgcgggcaatccggcaatacataaaattatctttgacgactatttacatgctgacaggtagagattttgaagaagaagatctcgggtttctggagcagctggcggcatcacacccggtgtggaaaagcgaagagttcggaacaaaaaatgcggcggagtttatgcttgcatactccatgtacaatggaacgtggctcgtatgggagattgacggcgctcctgccgccatcagttttcatttggaatgggcgccttcaaacggaaaaccgtggctcggaaccgtggccgtcgctccggaggcaaaagagaaaggaatcggacgcgcggtcattgaagagattgcgggccggctgagaggggagcataaagcgatgttttcagccgttcccctggacaggcaggaatgggttttgtttttaagccaatgcggctttgaacagcttaagcttgaaaaagacgatcgggaaaaaacatatatgatcatggtgaagccattgtgaaatgtttcagatataaaaaagagaccggatttctccggtctcttttcttgtttacaagccgaccgcattccaggccgcttctacgcttgcagcgtcttgagagccgtaaaggtcccgcgctgattgaatcaaagctgcttttgcatctttaaagcttgatgacggagtgagatataccgtcagtgcgcggtagtaaatctgctccgcttttttcacaccgatttttgtaatcgtgttgtaagcggctttgttcggaattccgctgtttgtatgcacgccgccgtagtcgccggcatcagtgttcggaaggtttcgataatttttgtaatggtcgggctgtccgtattttgtcggattggataaactgcggagagccggctggctgaccgtaatatcttcaccgatatcccagtcctcagtatcattgaagtatccgaatacatcagagaaggattcgtttaaagcgcccggctgattttcatagttcaggttggctgtttcctgtgtaacaccgtgtgtcatttcatgggccgttacgtccattgaaccggaaagaggcgagaagaatgagccgtcaccgtcaccgtaaatcatttgatcgccgatccaggccgcgttattgtatttgctgccgtaatgaacggaagatacgattttgccgcctttattgtcgtagctattgcgtttaaacgtctgatagaaataatcgtacactttgccgagattgtaatgcgcatcaacggcagcgcgctgagaagaagttgtgaactggtttgtagtgcttgatacgagcgtgcccggcaggttatattgtcggttttgcagatcgtacgtaataatttgcgttccggtaggtttagaaagatcacgcattacatatttgccgctttcagaagaaatatttaatgagaccgtttttcctttaagagtcgtacctgttccggttgcagcggcatgctccactttgttttgctttttcaggactttccctgtttccgcatcaacggttacttcccagttagctggttccggttcgatgtagcggatggttacatcataggcgaggcggtatttaccgtcttttgtggccgctgctttcagctcggctttgtttttgtttgcaacgttgccgctagagacggcttcaggtgatttgccgattgctttaaaagcatgatccagcgcttgatttgcagataattttttgctgtttgccgttttggcagaagcatcgttgtttaattcaccgttaatcgcatagacattgttggatttatcgacgtgaataatgacttgcgagtctttcacaggcacaccgttaacgacaggcacataacggaagtgcttgtagccgagatcatcggtcgtgtggtcaatcagcttcagtctctcagaagggttgcctttgaagactttgccgttttgtttcaagtattgcttgattgctttgtcactgactgaaggcaattcagattgcaccaaagaatgcttcggcacaaagttcgtcaggttttctttaagctgaggattctcagcggcctgaacacccggaagactgatggttaaactcataaaggaagcggcgacagcaacagacaatttcttacctaaacccacaataaatccccctttttgaaaataatgaaaacttatattgttataataaaccagcattctctcattctgcaatataaaactagactccgctgatgaattgatagaatcgtcccggaaaggcttccggcggccagcatcgggggataagccgagaggcacgtgttgaatcagacatgagtcgaatgatgcgatttattctgaaaaaaatgacaaatgaagtcgggaaaaatgatagggggaaaatgttccgatttgtaaaactttttttatagccgtttgtctaaacgggtgaggccttaataaacgaaaaggattgtttcagatgtcagagattttcagtcattttattcagcatttcgacagatatttcattttaagcagacagagcgtgttgatcattcagtggtcagccgtctgccttgctgttttatacgcgctgacttttcatccgaaaatcagccgtgagagagtctggttttattcaggaactctgctcagggccgtattattagcgggcataacagttgaattggttcatcaggtgcagagtactcactttagcgcgcactatttgatatcggaagaaagcgagcttctgccgatcgttcatctcttaatgtatgggtatgtgctgctcaccgcgtttcactatatcctcatgccgcaggagcagaggggaaagggcatgttttatacgtttgatctcactgtggtgacactgcccgtcattcagctgatcttcagctttttcgctttctggaatatcagtcccgatgcgatggcgggggaggatatagtttcgatgctatgttttattacggttgttttacttctgctgatttctatgaatgttttattctttaaaatgtattggaaaccgagacccgtttttatcggcgtgttttatgccggggtcatcggactgttggtatgggtgctcgctgcgccctcggccggtgtaacaaaagattacggcagacttctcccatttacggtgtatttaacgatggccggttttctgatgacccatcatttatttcatcggtcagacaggatcagacagcggacgaaaagctttcttgcggcggcaacggccgctggttttattgtctttttgaatccggtatacaatgcgggcgatgcagcttttgcggtttcaaagccgatagctgaagattctgttgataatgtgggtgaacatatcacttcagaccaagcggaacggatccttacttcattttttccggctgagaatccgatttatttaacagaaaccaatcaggacctccattacttttaccgttttaaaacggaagattatgaagcggaagtggacgaggtttcccgattgattacaaattatcaatatcttaaaaaaccggaaggccgcacttttacagaagaggaataccggaaaaagtcgctggatttcttatcggcacacggccgaaaaataaaaacacaaggcattcagacaacagtgagaaaagaaaacggacagtttgtcgtggagattgcgccgaaaacacaagggacgaaacacgaagattcgggcacagtattttactgggaaaaagacaccattatgggtttttcagaagatccgtctatttatcagcttgagtccctgccgcaggtgcatatgacggaaaaagacatagtgaaagcatcaaaagccgcctttcgtacgcttcaaatgcctgatcagacatttgaaatcacaaatacagatataaacagcctgatcggcagcagtttgaccgtaactgcgaataacggaacggagctgatatttgatgcagtatccggacgtcttatgaaaatcagagtctcacctgacagcaccgttttaacaaaaacagaacttcagaaaaagcttttttcattgctgggtgcggatacttcaaagcttagacagattgacaaatcggaaggcaatctcgtttttgaaaactctgaaggcacattcgtttatacgctccagaatgaagaaggcatgaaagaggcctcattctacggacagggaagtgccaaaacattcccgcatacatacagagacggacaaacagcattcaaaaaagtggcggcagcttataacggcatcatttacaaaaagcgggtgaagcctgtcatagcggtgaaagacggcgtaacatataacgcatggcttgtcattattcagccgttcggttcaaaccgtcatgacgtatatgtagtgaacgcggatacttacgaggcggtgaacctttatgaacaataaagaaaaaaaggctgtcttcttcgatttatacgacctatataaggagggggaactcgaaggcggcacgctccagtggatgaaagaacatgagcctttattcggagctgaggcggaaaacagaaaagggcagaatgaacatggtttgaatgcgccgtccggcgatatccgccagattaagtacatgaaatgcctgacgtatggattgtacggattcttcattgtgctctcaatctggatgacagtgtggttttacttttaaatgaaaaacaagatgtcaattgaacagctgtaccgtgaacattatcaagatattatgtattacctttacagacgcacacaacatgctgagaccgctaaggacctcgctcaggatacatttatgaaagcatttaacgggcttgagtcgtttaagggacattcgtctatcagaacgtggctctatgcaattgcccatcataccttcatcaattggtacagacgtgatagaaaatatcaattttcagatatcaccctgaatgaagggcttcagcaaacaacatatgaactgccggagcattacgtcgcccggacagacactcagaatgcgctgaccgggcagattcagcgtctgaaaagcgatcagcagaccgttttaattttaagggaatttcaagagctgtcttacgaagagattgctgatgttttggactggagtctttcgaaggtgaagagcaccctgtacagggcgagaatgcagctgaaacagcatttggcggaaaaaaggaaggacggacagatatgacttgctgtttagtgagagatttactgcctttatatattgaaggcgattgtgaaacagaaacggagcggtttatttcccgccatcttgaatcatgcggtaagtgcgggagtttatatcatatgatgaaggagccgcttgacctcggcagccctgagatgaaggcgcccccctgttatgcagaagaagaaaggcggtttaaggaacggtattacgggaagctgctgataaaagcagccggtttgttcggcgctgttttctttatcatgctgatccttaaaatgctgatttaaaaaaacgcccggctgaatgaccgggcgttttatccgtttactcagccggatgaaaggctgtataaatgccttcaagcaattcctgcggcagtgaattaaagaatccggcacacagctttgcttctttttttcctgctcctgctttttcagcaaggtcctgatcaaacgtatacacaccgtcttcttcaatcagcgcagattgaaggatatgaagactttgggaaaaagcggtgaacagctgatcaacgataagggcctctttttccgtaaagccgagctccaccgctttttctttattaaatgtatattcgccgtccgttttctcaatacattgagaaagaacggttaaaaattcggttgaactgtcccacagcttttgaatggtctgtgcggtttctttatctaatcccaattcaaccgctttttcaccgtcaaaataatagacgccgtctttttcgtaaatcgattggctgatgatgtcaatgagttttgccgcgtcttccggtgttttctctgcggaagcctgcaggatatgcggttcatttgcctggatcgtttttgcgccggcagaatcaagcggactgaatgcaagcaaggcggctgaggcggttgcggcggcagttacagcggttttcttcaaaaaagatgttttcatttcgttctctccttgtcatgtgtatttgcttacagccacaagtataaaaagacaatgatggaattgatataggaggtatggtattttctgcataacgatgccggactatttcagacttcattttctgagggaatctgctgatgtaactagagtgggggccgtcatttccggcttcctgactaggcggcgggggagataagccttacatctaaagcctgttttgaggatgtaaaaaagcctgaatctttgattcaggctttattagatattgtgcttttcatgtttacggaattttgcaaagggtcatgcttttaatcaagcagtccctgttcgcgcatttttttctttacggtgaaaccgcttcccatcatggcgataacgagaacaatgcttccgatgatgccccatgcgcttttctcagcgattgatacgccgatcagcatcatgctgaagactgctgcgaatgcaaataataataagagccaattcaattttttcatatttccatcccctttaacgtcatactttcagtttacagaaaaacgtaacgcttttaaagaggatgtgtggtataatatgaaagttatctaatttttttaggagatgaaaatgtgaaacttcgaaacgatcttcgcaacatcgcgattattgcccacgttgaccatgggaaaacgactttggtagaccaattgcttcaccaagccggaacattccgtgccaacgaaaatattgccgagcgcgcaatggattcaaacgatcttgaacgtgaacgcggtattacaattcttgcgaaaaatactgcgattaactataaagatacacgcattaatattttggacactccgggacacgccgacttcggcggagaggtagaacggattatgaaaatggttgacggcgttctgttagtcgttgacgcatatgaaggctgcatgccgcaaacccgttttgtactgaaaaaagcccttgagcagaacttaaatccggttgtcgtcgtaaacaaaatcgaccgtgatttcgcccgtccggaagaagtcattgatgaagtgcttgatttgttcatcgagcttgacgcaaacgaagaacagcttgagttccctgtcgtctatgcttctgcgattaacggaacggcaagtctggatccgaaaaagcaggacgaaaatatggaatcactgtatgaaacgattcttgaacatgtccctgccccggttgataacgccgaagagcctcttcaattccaagtggcgctgcttgattacaatgattatgtcggccgtatcggtatcggacgcgttttccgcggcacgatgaaagtgggtcagcaggtttcattgatgaaacttgacggaacggttaaatcattccgcgtaacgaaaatcttcggtttccaaggattgaaacgcgtggaaattgaagaagcgagagcgggagaccttgttgccgtttcgggcatggaagacatcaacgtcggtgaaacggtttgtccggctgaccaccatgagccgctgccggttctgcgcattgatgagccaacgctccaaatgacatttgtcgtaaacaacagcccgtttgcaggccgtgaaggcaaatatgtcacatcccgtaaaattgaagagcgtctgaacgcgcagcttcaaacagatgtcagtcttcgtgtcgaaccgactgcatcacctgacgcatgggttgtttcaggacgcggtgagcttcacctgtccattttaattgaaaacatgcgccgtgaaggctatgagcttcaagtgtctaagcctgaagttatcattaaggaaatcgacggcgtaagctgcgagcctgttgagcgcgtgcagattgacgtgcctgaagagcataccggttctgttatggaatcaatgggtgcgagaaaaggcgaaatgcttgatatgattaataacggaaacggccaggtccgcctgatctttaccgtaccttcacgcggactcatcggctattctactgagtttctgtcactgacacgcggtttcggtatcctgaaccacacgtttgacagctatcagccgatgcaaaaaggccaagtcggaggccgccgtcagggtgtgctcgtttccatggaaaacggaaaagcgacatcttacggaattcaaggtattgaagaccgcggcgtcatcttcgttgagcctggaacagaagtatatgaaggcatgattgtcggcgaacataaccgtgacaatgaccttgtcgtcaatgtcagcaaaatgaaacagcagacaaacgtccgttccgctacgaaggatcaaacgactacgattaagaaagcgcgcattatgtcgcttgaagaatcactcgagtacttaaacgaagatgaatactgcgaagtaacgccggaatccatccgtttaagaaagaaaatcctgaataaaaacgaacgtgaaaaagcggcgaaaaagaaaaaaacagcaggaatgtcttaatcacttgcagaatttgaaaaggtagaacccgaacggaaaaggggagggggatctttttgaatgaagtaagtgaacggctgtcgttctttgcggctctttaccaagtggatgagcatccgctggcgggaatgtggctgttatacggaacgatcgtcgtgctttcggtgattgtatttaaactcggctttgccaaacggctgccggtgttgaaggctgcggcagtttatctctttctcgtgctcggctgcaccgtgctgacttttttcggtgtgtttctgccggtcggagaagggcttgttgtcgccgccttgattttgatcgtttacaaaatccgtctgcaccagtccaaaaaaagccagtcagctaaaccgcaataaaaaaatgaccttgccttccggcgggtcattttttattcggtttattttttcagtttatcttttttcgctttttgtccgggatgaaaggaaaagtgtccggtattcagccgcgcctccgttttgactttgattcggtcatggcattcccggcacatatatgtatgaatcggacgattgcggaggcgtttggctgtcagtgtttcatcatcaatttgttcgattttgtcgcaaatggaacattttactctcattgatttttcacctctttcactatgacaagcattatatcatggatgcccctcctgccaaagggaaagaaagcagcgcccttcctttggagcgggcgctgctttttactggcggtttttcatatgatgatccgattgatcgttctgttcgttctgcagcttgttctggtctctttggttcagctgatcatcattcgattgagtcggtgattctttttcattgtcggtcacatcattcgggacttccggcatgacacgaccgacgatggcggcaagttcgtccaaaatgcctgaaacggggcggccggctttaatgtcgctgcccatgcctctcagacgggaaaccgtatcaggatcagccacgacaacggcattggcgccgtaaggatcgttttttaacgcctgggcaacggtgtatttaatgctctccactttgcttctttctaaattgtcatccacatcgattccgacaacggagtatcttccgagtacaaccgcggtggcatctgaaatgccggggattttttcggttacttcgacgagatgcttagcgatgtctgtccggccgggattttcagctgtctcaggagccgtatttttcacatgaatcggttttgcatcacgctgatcggttgattcgttctggatattgcggcctcggccgtcctgtacagcagtgcagccggtcaggataaacaaggcttgtatgataatgaaaagaattcgcacgtcagattccctccttgaatgctttcatttattttattgttgaattaaccttctatctttattcaccaaatcatatattttagcaggcatccccgtttttcgcggaaagagaagcacacgatgggctttgatccttatttcaggaggctgagacttgagtaaaatttatgtgttagatacgaatgtacttttgcaggatcctaacgccattttttcctttgaagaaaacgaagttgtcatccccgccgtcgtgctggaagaggtcgattcaaaaaagcggtatatggacgaggtcgggagaaatgcgaggcacgtatctaagctgatagacgggctcagggagaaaggtaggctgcatgagaaagttccgcttgaaagcggaggaacgctcagaattgaactgaaccaccggtcatttcatcagctccaagaaatttttatcgaaaaaacgaatgataaccgcattttggcggtggcaaaaaatttaagccttgaggaggaaacgaaagaaaacggccgcctcgtcatcctggtcagcaaagatgtgcttgtcagggtaaaggcggatgccatcgggcttttggcggaggattttttaaacgacagagtcgttgaccatgatgaaatatatagcgggtacaaagatatatttatgaataaagagcggtttgcctcgttttataaaaacaaacaaattccagtcaaggagcttcagcagcatcaggtttatccgaatcaatttgtgctgatgaaagatgaattaggaggatcttcgtctgcggtcggcatggcggataagaaaggagagaccgtaaaaagacttgttttcgatgatgagcacgtatggggtatcaggccgaagaacgtccagcagacaatggcgcttgaactcctgctgagggaagatatctcgcttgtcaccctgatcggaaaagcgggaacgggaaaaaccttgcttgctctcgcggcagggcttctgcagactgaggatcttggtatttataaaaagctgatcgtcgcgcgtcccatcgtcccggtgggaaaggatatcggatatttgccgggcgaaaaagaggaaaagctcaagccgtggatgcagccgatctttgataatcttgaatttttattcaatgcgaaaaagccgggtgaacttgaagcgattttggcaggaatcggatcgattcaggtggaggcgctgacatacattcggggaagaagcattccggatcagtttattattattgatgaggcccagaatctgacgagacacgaggtcaaaacgcttttgacaagggtgggagagggaagcaaaattgtcctgatgggcgatccggagcaaatagatcacccatacttagacagtttaaacaacggacttgcttatgttgtagagcggtttaaaggacaaaccgtctccggcagcgtgaagcttgtgaaaggtgagagatccggccttgcacagcttgccgccgatttgttataaaacttcgatttctgtgacgcccgttatcggtttttcaaagtctccgtccacgtaaaaatggaccgggccgccgtcttgaagcggtttccccgcatcgctgaaatgcgcgattgcgtccatcgccttttcgagcggcacttcggttctttctgattttgaaataaatgcgcacaggacagcgctttctttcggctcggcatttgctaaaacagcgccgagcttcatggcgaagctgccgttcatcagtctttctttttcataacgtttttcgctttttaaagtcggcggcgaaatgcgcccttctctgatcacccgttccggatcaagtgtatgctcctgggttcctgcagagccgtccggatgaacgggctgattgttttcaaacggaaacttgcggtcatcgaaaatccagacactcggatcaattgtaatcgggtatgtaacattgccttttacttgaataacgctcatgttgaagcccccctttacttaaagtataaaagttttcgcatgaattgtcactttgcgtcgcaaacttagatgtatacaacggcagcgaagtgaggatgatcgacatggtatgccggcattaccaagagctggacgcattagttcaggaagcgaaaaaaaggaccgaagaaggcaaagtggcagactatattccggctcttgctgaatccgaacaagacagcctttcggtcacgatttatcatgcggaaaatacatgtctgacggcaggagacgccgaccggacatttacgctgcagagcatttcgaaagtgctttctctggcgctcgtactgatggattacggaaaggaaaaggtgttcagctgcgtgggtcaggagccgaccggcgacccgtttaattccatgattaagcttgaaacagtgaatccgggcaagcctttaaatccgatgattaatgcgggagctctcatcgttacgggtttaattaaaggtcattcgccgaaagaccgcctggattacctgctcggattcatcagaagacttgcgaacaatcaggacattacatattgcagacatgtcgcggaatcggaattcaaatcttccatgattaatcgggccatgtgttattacatgaagcagtatgacatttttaaaggcgatgttgaagaggtcatggatttgtatacaaaacagtgcgcgattaagatgagcagtctggatttagccaaaatcggctgtgtattcgcccttgacgggaagcatccggaaaccggggagcaggtcattaaaaaagatgtggcgagaatctgcaagacgtttatggtgacatgcggcatgtacaatgcgagcggggaattcgcaataaaggtcggcattcccgctaaaagcggcgtttcgggaggaatcatgggcatttcgccgtacaacttcggaatcggtatattcggcccggcgcttgatgaaaaaggcaacagcatcgcgggtgtgaagcttttggaaatcatgtctgagaaatacaggctgagtattttttgaaacattttttatcataacatctgcttaaatcctcttgcaatttcatctgataccctttatgataaatagaagaattaggtactcgcctggggaacggagggatacttttggcttcagagattatagttgaccatcagcagaaagcattcgagctgttgaagttagatgctgagaagattttgaagctgatccgagtacaaatggataacttaacgatgcctcaatgtcctctgtatgaagaggtcttggatactcagatgttcggactgtcgagggaaatcgattttgctgtccgcctgggattagttgacgaaaacgacggcaaagagctgctggacagacttgaaagagaactgtctgctttgcatgacgcgtttacaggaaaataaatgatcaaactcaaactattcaacggtttgggtttttttataaccgtaaaccgtttttttgcatcttcttttcgtaagacggtctcttaatctgcatttcatccgaaaaactataaagaaactgcgtaaattgtttatgaattatagtaaaatataatacgcaataggtattaaacgtaagctttaagcaggaaagaggatgttatgtttaaaagaatgttaaaatcttacgattattcattgatatgcgctatcattctgctgtgcagtttcggattggtcatggtatacagctcaagcatgattaccgccgttatgcgttacggcgtgagcagcgactatttctttaaacggcagctgttcgccgtcatcgcggggtttgtgctgtttattatcgcggccgtttttccgtacaaagtgttcgctcatcaaaagattcagaaattcgtactgcttgcgtcagtggctgcgctttgcgcgctgtttgttttcggacatgttgccggaaacgcgcaaagctggtttaaaatcggcggaatggccattcagccgggggaatttgtcaagctgaccctgatactgtaccttgccgcggtatacgcaaagaaacaaagctatatcgatcagcttttgacgggggttgcgccgccggtgatcgtcaccgtagtcatttgtgcgcttatcgctattcagcccgacttcggaacggcgatgattatcggtctgatcgcgttttgcgtcattatgtgttcgggattcagcggaaggaccctgctcaggctggttctcatggcgggaatcgtattgctccttgtcagcccgatcatctatctgaaatgggacgatattttgacacccgggcgtatgagccggtttgaaagccttgaaaatccctttaaatacgccagcacatcaggcctgcagattataaattcgtattatgcgatcggctcaggcggttttttcggtctcggtcttggagaaagcattcaaaaatacggttatctgcctgaatcgcatacagactttattatggcggttatatcagaggagctcggcattttcggcgtcctgtttgtcattgtactgctggcttttgtcgtgttaaaaggtttttatattgcgagaaaatgtgaagatccgttcggaagccttttggcaatcgggatatccagcatgattgcgattcagacctttatcaatctcggcggtgtcagcggtttaattccgatcacaggtgttccgctgccgtttatcagctacggaggctcatcaatgtttttgttattaacgagcgccggtatattggtgaatgtcagcatgcatgtcaagtactcagaaaagaagaaaaagagggagcccgttccgtctaagggggtaaaaagacggcagacggaaaaatctgtgtatctctaaaaaacaagtgtatacacagcacggatattcctttattataaactacatatttattaggccaagggggagaaaagtttgtcacaacaatccatccaaaaagtgttagtagcaaacaggggagaaattgcgatccggattttccgggcgtgcacagaattgaacatcagaacggtagccgtttattcaaaagaagattcgggctcctatcatcgctataaagcggatgaagcttatcttgtgggagaaggcaaaaaaccgattgacgcgtatcttgatattgaagggattattgagatcgcaaaaagaaacggcgtcgatgccattcatccgggctacggatttctctctgaaaatatccaatttgcgagacgctgtgaagaagagggcatcgtatttatcggaccgacgtcagcgcatttggatatgttcggagataaggtaaaggcgagggagcaggcagaaaaagccggcatccccgttattccggggagtgacggaccggctgaaacattaaaagatgtcgaacaattcgcaaaagtacacggatttccgtttattattaaagcatcgctcggaggcggaggccgcggaatgagaatcgtcagaagcgaaagcgaattgaaagaatcgtttgagcgggccaaatcagaagcgaaagccgcattcggaaacgatgaagtgtatgttgaaaaactgatcgaaaatcctaagcatattgaagttcaggtgatcggagataaagaaggcaatgtcgtccatctgtatgagcgggactgttccgttcagagacgccatcaaaaggtcattgaggtggcgccgagtgtatctttgcagcctgaattaagggacgaaatctgtgaagcggctgtggcgcttgcgaaaaatgtcggctatatcaacgcggggaccgtggaatttctcgtagcgggcggtgaattttactttattgaagtgaacccgcgcgtacaagtggagcatacgattacggaaatgataacgggggttgatatcgttcagacgcaaatcctcgtcgcgcagggccacggactgcacagccgtgccgtcaatatcccagagcagaaagacatttttacaaacgggtatgcgatacaatcacgtgtgaccaccgaagatccgctgaatgactttatgcctgacacgggtaaaattatggcttaccgctcaggcggcggcttcggcgtccgccttgatacgggaaacagcttccagggcgccgtcatcacgccttattatgattcactgctcgtcaagctgtcgacatgggcgctgacgtttgaacaggcatcagcgaaaatggtccgcaacctgcaggaattcaggatcagaggcattaagaccaatattccgtttcttgaaaacgtggcaaagcatgaaaaattcctgacgggccaatacgacacatcgtttatcgacacaacgcctgagctgtttgttttcccaaaacagaaggaccgcggaacaaaaatgctttcctatatcggcaatgtcacggtgaacggttttccgggaatcgggaaaaaagaaaaacctgcatttgataagcctcagaccgttacgttaggtatcgaagaaaagccggcaagcggtacgaaacagatccttgatgaaagaggcgctgaggggcttgcagactgggtgaaagagcaaaaatccgtgcttctgactgatacaacgttcagggatgcccatcagtccctgcttgcaacccggatcagatccaatgatttgaaaaaaatcgcgaatcctacggctgccctgtggcctgaactgttcagccttgaaatgtggggaggcgcgacatttgacgtagcgtaccgtttcttaaaagaagacccttggaaacgccttgaagatcttcgcaaagaagtgccgaacacattgttccagatgctccttcgttcatcaaatgccgtcggttatacaaactatccggacaatgtcatccaaaaatttgtccggcagtcagcggagtcaggtattgacgtattccggatctttgacagcctgaactgggtaaaagggatgacgctggccatcgatgccgtccgtgaaaccggaaaagtggcggaggctgcgatttgttacacgggagatattcttgataagacccggacgaaatatgatttgaagtattatctttctatggcgaaagagcttgaggcgtctggtgcgcacattctcggcattaaagacatggccggtcttttgaaacctcaagccgcatacgaacttatctcagcgctgaaggaaacgattgatattcccgttcatcttcacacgcatgatacgagcggcaatggcgtctttctctatgccaaagctgttgaagcgggtgtggacatcgtggatgtcgccgtcagctcaatggcgggtctgacttcacagccgagcgcaagcggattttatcatgcccttgaaggaaacagccgccgtcctgaaatggatgtccgccaggtggaaagactgtcacaatattgggaatcagtccgtcagtattacagtgaatttgaaagcgggatgaagtctccgcatactgagatttataatcatgaaatgccgggcggccagtacagcaatctgcagcagcaggcaaaaggagtcggcctcggtgatcgctggaatgaggtgaaagacatgtacagcgtcgtcaaccgcatgttcggcgacgtcgtgaaagtaacaccttcttccaaagtcgtcggagatatggcgctttacatggtgcaaaacaatttaacagaacaagatgtttatgataaaggcgaaacgcttgattttccggattcagtcgttgagctctttaaagggcagatcggccagccgcacggcggatttccggaaaaactgcaaaagctcgttctgaaaggacagacgccgatcacggtaagaccgggtgagctgcttgaaccggtatcttttgaaggcattaaagaagaatggaaagaaacacatcagatggaattgagtgatcaggacgcaatcgcgtatgctctttatccgaaggtgtttacagaatatgttaaaacagctgaacgcttcggtgatatttccgtattggacacaccgactttcttctacggcatgacactcggtgaagaaatcgaagtggaaatcgagcgcggaaaaacgctgatcgtgaagcttgtatctatcggtgaaccgcagccagatgcgacacgtgtcgtttatttcgaattgaacggccagccgcgcgaggtggtcattaaagatgaaagcataaaatcgtccgtacaggaaaaattaaaagcagatcggacaaacccaagccacattgcggcatccatgccgggaaccgtcattaaattgttaacggaaaccggggcaaaggtaaataaaggcgatcatctgatgattaatgaagcgatgaaaatggagacgacggtacaggcgccgttctccgggacgatacagcagattcatgtgaaaaacggtgaaccgattcagacaggtgatttactgatcgaaattgaaaaagcgtaaaaaatgaatataaaaaacctgatccgcccccgtgtgcgatcaggttttttatatgtagaaaggccgaagctctaatgcttcggccttttcatgtgcctcagatgttccgctgttttgattcatagcggaagcgggcgattaataataagaaatagcataagacgccgaacaggccggcaataaagagcgaatgggcaagtgcaaaaccggtggccatttctgaataaacaaccatgattccggacagcgcctgtaataaaacaaagacaagagccgctatccagccctcaagaatctgtttttgatctttgtaggagcgcaccgcatgcgcaaaagcgacaagaatccatacgaacagaagcagtgctgccgttctgtggcccatctgcacatattcctgaaaatgggacggaagcccgtggttcagcctgctgcaaagcggaacgtcagggcaggcaaggcttgatttcgtatggcgcacataagcccccgtataaacgacgatatacgtgtaaatcgaaaggccgatcatatgaaactgcattttcctgccgattctgagcggcttgacgagctttttgtctgatttatcagcttcaaatatgagcagcgtcaaaattagaacagaagcgaaagaaatcagcgatatgccgaaatgaagcgccataacgagcgcatttgatccgaaaacaaccgctaatgcgccgagaatcgcctgtaaaaataaaaagataatggacataatggcgagaaaggttgtttcacggaaaacaggcgtgacttttctccatgcccaaaaagcgaggctcagcacgagaacgattgagacaccgcttgcgagtctgtggctccattcaatgatagaagcggcgttaagctccgggaaaaaccggccgtggcaaagcggccactgccttccgcaaccgagacccgatcctgtctttgtgacaagagcgccgccgatcagcacgacgagcatgacgaatgtcgtcagtacgccgagcgctttcaaagctttattcattttacattcaccttcttaacaaactggacaaaatgatatacgtaccaagtgtaagcgaatatgtgttttgtggcaattctcaattctgtttgttcacaaaaatataatagaatcaggacttcttagataatggggttgattattccagatgggtctgatagaaataaagtaaccgctttattaagaaaccggcggatttggtaaaattcataaaaagttcacaaataaattcctgtttctcgtttaatatttaagaggatgtttttttacaggtcattatcttgtatgatagagttgcaggtcttaaaaaacctgctttaggtttgtaagggaggtttacgttatggctaattccagaattttaaacgatacagctatagacggacagattgaagagacgacggcatggaaggatttcctttcgcttatcaaaataggaatcgtcaattcgaatttaattacgacttttaccggcatgtggcttgcgttacatatatccggtctgagttttttaggcaatttaaacaccgtgcttcttacattaataggatcttctttgatcatcgccggttcttgtgcggttaacaactattacgatcgtgatattgatcatttaatggaacgcacgaaagtaagaccgacggtaaccggaaagattcagccgaatcaagcgctgtggtcaggaattttactcattgctttaggacttatcatgctcttgatgaccactgtgatggcagcagtcatcggttttatcggcgtgtttacgtacgttgttctttatacaatgtggacgaaacgccgttatacgattaatacggttgtcggaagtgtatcaggcgccgtgccgccgttaatcggctggacagcggttgaagggcacatcggtgttgtcgcgtgggttttattcatgattttattcatctggcagattccgcactttttagcgcttgcgattaaaaagacggaagattacagagcagcgaatatcccgatgcttccggtagtgcacggctttgaagtgacgaaaagacagattatcgtctgggtcgcatgcctgctgcctcttccgtttttcctcggcagtctcggtcttccgatcgtcattctcggcactttgctgaatgtcggatggcttgttctcggactgatgggattccgcatgaaaaacatcatgaagtgggcaactcttatgtttgtctattcgcttaattacatgaccatttattttgtagcgatggtggtcttcacgctgttttaattgaataatgagcttgtttgatcgccaaaacaaacaatgacaactagtaaacgccgccttgaccttttgtttaatcaggcggctttgcttttatacatagatggaattttaagtaaaaaatctcatattttaagaaatgaggaaatgaagtatttcggctggaagcagatttactgcttgtgcatctcgtactgattcaaaaaaaggggttgggtgaaatgttaaagcgttggcgtcttttatcattattagccttagtgccgcttttattgagcggctgtggaaaaccgtttctgtccacactcaagcctgccggcgaagtggctgataaacaatatgatctgacggtgctcagcacacttatcatggttgtcgtcgttgcggtcgtagcagttattttcttttacgtcattgtgagattcagacggtcgcgtgtaggggaagacacgataccgaaacaggtggaggggaaccgttttttagaaatcacctggaccgttattccgatcctgcttctgattattcttgtcattccggttgtcatcgacacattggcgctggcggatacgtcgccgatggataagaaaaaccgtaaagcagaggatgcgctcgtgattaatgtaagggcgaatttatactggtgggaattcgagtatcctgattacgggtttgtgacaagtcaggagctgatcgttcccacagatgaacgcgtctatttcaagctgaagtcctcagatgtgaaacactctttctggattccgtcagccggggggaaaatcgatacgaatacggataatgacaatactttctttctgaccttcgattctaaacgcagcaaagaagcgggagaatatttcttcgggaaatgcgcagagctgtgcggaccttcacatgcgctgatggatttcaaagtgaaaccgctgccgtcaaaagaatttaaacaatggacgaaagcgatgaaaaattataagcatacaacagattccggtttagccgcgcaaggagaagagctctttaaggaaaaaaactgcctgagctgtcatgcggttgagcccaatgataaacgggctgaagcggcaagaacggctccgaacctcgctaccttcggtgaacgggtcaaagtggccggcattaaggatgcgaataaagagaatataaaagcctggctgaaaaatccggacagcattaaaccgggcaataaaatgacaggcacttatccgaagctctcggacgctgaaacggatgcgctgtatgaatatttaaaagggctgaaagcggagaacaagtgaggacagggagatatcaggggggaggtcgcaaatgatgaatacgcttacaggacagcaaagaaaaagctctttgctttgggattatttgacgacggttgaccataagaaaatcgcgattttatatatgatcgccgggggatttttcttcgtcgtcggcggacttgaggccatgcttatcaggattcagctcttgaggccggggaacgattttatgggtgcgcagcagtttaatgaaaatatgacgatgcacggcacgacaatgatcttcctggcggcgatgccgctgttattcgggctgatgaacgcggttgtgccgctgcagatcggggcgcgtgacgtatcattcccatttttgaatgcgctcggattttggctgtttttcttcggaggcatctttttgaatctgagctggtttttagggggcgctcctgatgcaggatggacgtcgtacgcgtcacttgcgctgaattcgaaagggcacggcatagactttttcgtgctcggcctgcaaatatcaggcttaggtacgctgattgcggggatcaattttctcgccacgattattaatatgagggcgccgggtttgacgtatatgagattgccgctgtttacgtggacgacatttgtggcgtcggcactcattttattcgcatttcctccgctcaccgtcggtttggcgctgatgatgctggatcgtttgttcggaacgaatttctttaatcctgaattgggcggcaatacgataatctgggagcatctgttttggattttcgggcatccggaagtgtacattttaattcttcccgcctttgggattttttcagaaatcattcccgtatttgcgaggaaacgtctgttcggttattcgtctatggtctttgcgatcgtgctgatcggctttctcgggttcatggtttgggttcaccatatgtttacgacgggactcggaccgatcgctaatgcgatatttgcggttgcgacgatggcgatcgcggtgcctacgggcattaaaattttcaactggcttttgaccatctggggaggaaatgtcaaattcacgacgcctatgctgtatgccgtcgcctttattccttctttcgtactcggaggagtcacgggtgtcatgctggcggccgcagcggcagattatcagttccatgatacgtattttgtcgtagcgcatttccactacgtcattatcggcggcgttgtgttcggcatcctggcgggcgtgcatttctggtggccgaaaatgttcgggaaggtgcttcatgaaacgatgggaaaaatttcgttcgtcttattttttatcgggtttcatcttaccttcttcattcagcatttcctcggcttgatgggaatgccgcggcgcgtttacacatatctgcccggccaggggcttgataccggcaacctgatcagttcaatcggcgcgtttttcatggcgggcgcggcagttttactcgtcgtcaatattatttatacctcaataaaggggaaatacgtcgggaacgacccgtggctggacggtcgtacgcttgaatgggcggtctcttcgccgccgccggaatataattttaaacagcttccgtttgtccggggacttgacccgctgtggattgaaaagcaggccggaaatgaagggatggcgcctgcagagcctgtagaggacattcatatgccgaacggctccatcatgccgtttatcatatctttcgggctgtttgtcgcagcgtttgggtttttataccactccgattattcatgggggcttccggttatcttcatagggctcggcatcacattctttaccatgctgcttcgctctgtggtcgatgattacggctatcatattcacaaagaagatctgccgaatgatgataaaggggtgaaggcgtaatgcagctgcaggaaaaaatgacggctgaaacctttccggcttctcctgaaaaagcaacgttggaggggaaaaataagtttttgggattttggctgtttctcggcggcgaaacggtcctgttcgcctcgctatttgcgacatttcttgctttacgggaatctaaagccggagggccgtcaacgtctgagatgtttgagctgccgatcgtgtttatcgcgacgatgcttcttttaacgagcagcttaacgagtgtgtatgcgatgtatcatatgaaaaatttctcctttaaaaaaatgcaggtgtggcttctggttaccgtattattgggagcgggatttttaggggtagaaatctatgaatttatgcattacactcacgaattcggctttaccattacaagctctgcgctcggctcagcgttttacacgctcgtcggcacacacggagcacacgtggcgttcgggctgttgtggatcagcgcgctgatgatccggaatgcgaaaagagggctcagcctttataatgcgccgaaatattatgtggccagcttatattggcattttatcgatgtcgtgtgggtctttatctttaccgttgtatatttgatggggatggtgggataacgatggacgataacaaaaacagagggactgtcagtacggatctcgaatatcggaaaaagaaaaatgccgaggagatgaaatatcaggtcatatccttcggtttgatgatcggccttacgcttgtcgcgtttttgacggtggctgctgacggcattgccggatggtttacgatgccgtttctgatcctgcttgcggtcatccaggtcatctttcagctgttttactttatgcatatgagccaaaaggggcatgaagcgccgtcattatttctgtattcgggaatatttgtcgcgtttatcaccgtgcttgcatttgtcacgattatttggtggtaatcggggcggcggggagtgagagatttgattaatttggaaatgttcgggtttcgcgcaatgtggagcccgtatctgttttgcataactgccgtgataacaggtgtttacttttactggtgcagccggcataaaggacgtgtggccgctaaggagaaggtgctgtttgtgctttccgcgctatttttttacacggctgcgggaagtccggttgatttattgggccatgtgatgttcagcgcccatatgacgcagatggcggttctgtttttagtcgtaccgccgctgttgatttccggaattcccggctgggcatggaaaaaactgatcttccgtcctgtcgtaaagccgctgttttcgttcttttcaatgccgcttatcgcattagtgctgtttaacggtattttttcactgtatcacatcccgtttatatttgatttcgtcaaaacggattcgctgtatcatacgctgatgaacggactcatctttgtaacggcgttttttatgtggtggccgcttgtgcataaggtggacggtctgccccgtctcagcggtttaatgaagctggggtatattatggcagacgggattctgttaacaccggcctgcgcgctcattatgttcagcggggcgcccatgtatgccacgtatacagatccggcggcttgggccgaagcaatgaagctttgcgttcctttagacttgttggaggagatccctttatccggaccggagatgtttaacacgctccctcctctggaagatcagcagcttggtgcagtactgatgaaaatcattcaagaggcggtctacggaacatatttggctgtcatcttttttcagtgggtcagaacggaacgggaaaaagatacgctgtcagagccgccgtatatcgagcataccgtctcgtaaaaaaagtacagcagaatatgctgtacttttttattacatttgcactgtttttaatgactcttccaattcaagcagtaaagctttgctttcagcgacgacatgttccggaaattcttcagcgctgccgtattctacgccgtgcggataataatgctttcctaaaagaggggccttcagctgaatcacggcccggctgccgccgacatcgccctcttttgccgttccttgaatccgcagataaaatgtcccctcaggtactgaaaactttttgtcgtaagtcactctttcataatcccattgtccagccagaatgagtcctttgccttccatcagatcattcaagcggctgagttccgctgttaccccttcaagaccgctgttttcaaacttcaaaccttccccctccttttaaaaatgccctttcctgacaatcatagtatgaaagcgttacactttcaatgattcatacggtgaaagtatgcaaaaagaaaaatttgacgacaatagtagcagaaaaaggaggaattccgcaatgacaaagatcaataagctcatgacgtcagacttgcaatattgtacagtattagataatgtatatgaagctgcggtgaagatgaaagacgcggatgtcggcgccattccgatagtggatgaagacggcgcgacccttgtcgggatcgtgacagacagagatctcgtattacggggaattgcttcaaaaaagccgaactctcaaaaaataaccgacgcaatgacagagcgggttatcagtgcagaagaagacgcctctgtggaggaggtgctccatttgatggctgaacatcagctcagaagaattcccgtcacaaaggataaaaaactggtcggcattgttacgctcggcgatctttcgttggccgagcaatcaaatgagcaagcaggccgggtgctgtctgacatttctgaagacggcggtccggaggggtttatccattaaacataaatcacggacgatgcaaataggctgtactgtataagagtaaacaaaaacagaacggtttgaacatatgggggtgagaggttgaaaaatatcgcaagggctctcgttatccttttgcttatttacggagcgtatgttctgtttatacaatatggatcggctcctcagaaaaagacggatcaggaggagcctcaggtttccaatgaagaagagagcggaaaacggctgaaaatgccgtcatccggactgctttctctcatggggaaatctgccgccgatgtgaaaaagaaacttggggaaccgtcccggaaagatccttctgcctacgattacgagtggtgggtgtacaaccaggggaaagaccaatacgtacaagtcggtattttgaatgataaagccgtgactttgtacgcttcgggaagcggcatcaacgcaaaaccgtttaagatcggcgaatcgacgggcgaagtttttaaaacgacgcaggtttctccttttgtcaatgtgactgacaagggaaacacgtatcggttcgagttttctgaagaagatatcaatacccgtcccaccgtcaagataggcggaatgtatgttcagctgtacatggacaaatttgacgggaatctgtcaagcatcagggcatttgatgcggaaacacttgtgaaacaaaggccgtatgaagtcatgtacagaggaaagctgacagaacccgagccagtttctgatgaaaaatggaacgacattgaacgagcgagtgagcagcagattctcgacattacaaatgtcatccgcgtgaaacacggactggcaaggctgaaatgggacgaaggcgccgcaaaagtggcattcggccacagcaaggacatgaaggataacaagtatttctctcacgtctcaaagaaatacgggactctgaaggaccgcttagaaaaaggcgatgtgaaataccgggaggccggtgaaaatattgcctacaactatgtggacggtcctgccgccgtggagggctggctgaacagcgaaggccacagaaaggcgctgttaagcccggattatacgcacctcggtgtcggcgtggaccggaagtattatacgcaaaacttcattaagccttggcagtaaaaaaccgcagaggggcgcgtcccccgcggtttttttatgttttttcgcgagcggcgctcctgctgaaaaaaatatacctgctttttttcgcaatttaggcgaacattaaggcgaatgaaccgatacattatagcaggcaaaacttttcggagggagtgagaattgtggcgaatcagcaatcacggcaatcaatcgatgattttaaacaattcgtaaaaaagcatcccaaactgatccaaaatgttcgcaaggaacaaaggagctggcaggaagtctatgaaaattgggttcttctgggcgaggatgatccgatatgggatccttttaaagacgaggccgttcagccttcttccgacgcggaaaccaaacaggaaccagctgaaaaaaacgatttcgtttcaaaaatggtcactgccgtcaaaaagatggatatcaaccaaatgaatgagcagatcaataaaatgagccagtccatttcatcattgcaaagccttttaagccaattttcggggagcagcacgaagcagccccggcaaggctccggacaacatcctttttcgttcagaaaggattaaagaaggggatcgtgtatgcgaaaagaggttcaggaattcatatccgcagatgaggaacggaaacggtttatacggcagcgtcccgtctggtaccgcagacttgcgagaaaaccggacgatctcaattcctttcagcttgacatgatgaatttttatgaaaagacgataccgcatcgggtaagccaattctcaaacgggattcaaatggcgcagatgatgatgcagatggttcacgccatgcgttcacaggattaaaaagcgtttaaacgccgcattttccaattgggtggtttcatggtaaactagcaactggaggtgcgtatttatgtatgcaacaattgagtccgtcaagcttcaaagtgaagcggagcagcttgccggcatgattctgcagtctgagacggctgaaaattaccgcgattgttacaagcgtctccgtgaagatgaagaggcagggcggatcattcgttcttttatgagcgttaaagagcagtatgaggatgtgcagcgctttggcaaataccatcctgattatagagagatttcccgcaaaatgagagaaatgaagcgggaactggatttaaacgataaggtggccgaatttaaaaaagcggagactgagcttcagtcgctgcttgacgagatcagcattgaactcggaacggccgtctcggagcatgtaaaagttccgacggggaatccttattttgacggcctgtcatcctgcggcggcgggtgcggttccggcggcggctgcggatgcaaagtttcctgacgagacggccgtctcgtcttttacataaaatgaacagaaagtcaggcgggtgatcatgatggaaaataagcgccaaggcataatcgtatatctgcattctttaaaacacagcaaaatgctgagaaaattcggcaacgttcattatgtttccaagcggctgaaatacgttgtgctgtattgcgatatggatctaatcgaaaaaacaatggaaaagatttcttcttattcttatgtgaagaaggtagagccttcttataaaccttttttaaagctggaatttgaatcaaagcttgataaagcgaaagagtacgattataaaatcggcatataaaaaaatccccgcagatacctgcggggtccttctattccttaacaagttaaggagaaggaaaagggagaggagaaaccggaggaagaacttatggggaaacgtaagtcttctccgcggttggcaacaacatcattcattgatgctgttacacttagtcttgacaggaatgtgaatatgtatacacgatttcacgttcattgtttgaaagaatgctttatgataagatagggattgttttgatacataacggctcagccgatgagaaacatcaaagttttcagaaaaagtggtgtgaataatgagagtaatttccggttcaagaaaaggacgagccttaaaggctgtgccgggcacatcaacaaggccgacgacggataaagtaaaagagtctatttttaatatgatcggcccgtattttgacggaggaacggggctggatttgtttgcggggagcggcggtctcgggattgaagcgctgtcgcgcggatttgaccgctgtatctttgtggatcgtgatttcaaagccatccaaacggtaaaagcgaatatcaaagcgcttgatctgctgtcttcagcggaagtataccgcaatgatgcagagcgggccctctatgccgcggcgaaacgggaaaaaggttttgacggaattttcttagatcctccgtataaggaacaaaagctgaaagcgcttatcgaaatgattgatgagcagaacatgctgaatgaaggcggttttgtcgtagccgagcatgataaagccgttgtgcttcctgaagccgtcggcgcgctttccgtaacaagaagggaaatttacgggcttacaggagtgacgatataccgaaatagggggtaatgatgtggcaagtatagctgtatgtcccggaagttttgatcccgtcacctacggacacctggacattatcagacggggggcaaacgtgtttgagcaggtgtacgtatgcgtgctcaataattcttctaagcagccgctgtttacagttgaggaacgatgtgagctgttaagagaagtgacaaaagacataccgaatgttacggtcgagacgtcacagggactgttaatcaactatgcgaaaaaaaagcgggcgaaggcgattatcagggggctcagagccgtttctgacttcgaatatgagatgcaggggacttccgtcaaccgcgtgctcgacgaatcaatagaaactttttttatgatgacgaacaatcagtactcttttttaagttcaagcatcgtaaaagaagtcgcaaaatataacgggcctgtttcagagtttgttcctccggaagttgaacaggcgctgaagcagaaatttaaaggatgagaagcgctgattagcgtctcatcctttttttgtccgtgctgacagcctgtagcaataaatcaatgcgtatacggcgagagctgtcagcgtgatggcgggaccggtttcaacaagtgtattccaaccgctgacggcagcagataccgcttcctgatcgcggaaagggaggaatacggactggtaaggttcgtccaatgcaaggtaaagcggcttccacagtaagagaataaagagtgcggcataaatgccctgaaggatacgcgccgcgaaaaacggtttaaagcggatatctgtttccgataaaatgccggctacctgggcctgtacggaaaggccgctgaacccgagaataaaactcacaatcatggctttcggcagcaagtcggcatcagcttcactgaccagtttgctcccaagtgtaatttcaaacatcccgctgataagagggatgtccagatttgccggaagatgaaaaagcgaaagcagcgcgtttgtaaatacagaaagcacatccatgacttgtacgattgataataatcggctgaaaaccgaaaacaatataataaaaccgcccaccatcagcaaggtttgtacagaagaggtgacggcgtcgcccaaaatttttccgagcggccgcttttccgaaagccgcgccttgtggagggccagaaatgcttccttcagagaagggagagcgatcgtctttttaccggtatacgccgcttcttctttccgtccgtatgaacgcatcgtcaggccgacggcgatgtttccgagatagtgagccgatgccagcagaatgccgagagacgcgttatgaaaaaagccgaccgctacagcagcgaatataaataacggattggatgaattggtaaaagagacgaggcgttcagcctctactctggagatttgtttatcctggcgcagccgtgcagtcagcttcgcgccggccggattgcctgaagccatgcccatagccagtacaaatccgccgacccccggcactctgaaaatgggacgcataaagggttcgagtaaaaggccgacaaacttgacaatgccgaatccgattaaaagctcagatagaataaaaaacggaagcaatgaaggaaaaactacctcccaccacatggaaagaccggttttggaggcttcgaatgaggcctgagggtgtgaaataaccgtcgccgtcaaaaaaatgaaaaacaatgaaatcaaaaatgtatgaaacttagacaaattcattcttacctccccgatgctaaaattgcacactgacatttatatcatgataaaatatagaacagaccttaaaggcggccgggcaagtacctatttgtcatcctgtactaatatacgagcataggggttcaatttagaccatagaattcatgtataggatgtctattagggggttcgtcgcgttggccaaacctacaatcgggttagcgttaggttcgggaggggcaagaggcatcgctcatctcggagtgttatccagtttacataagcatcagattccaattgatatgattgccggcagcagcatgggagcgttagtcgggagcttttatgcggccgggcatgacgtggccacgatgaaaaaagtcgccaaagcatttaagcggcggctgtacgcggattatacgatgccgaggctcggatttttaaaaggggaccgcatcaggcagctcgtgcatgcctatacgtacggcaagccgatagaagaactgcagatcccgctcggcatcgtggcctgcgaccttcagaccggcgaaaaactcgtttttacgaaaggttcagtatccgaagccgtccgcgcgagcatcagcataccgggcgttttcgtcccgcaaaaaatgaacggacgtatgttagtcgacggcgcggtggtcgacagaatcccggtttccgccgtaaaagatatgggtgctgatatcgtcatcgcctctgacgtatcccgggtgaaaaaaacggaaaaggcggcacatatttttgatgtaatcatgcaaagtatggatatactgcaaaatgaattggtccgtcaccagaccattgccgcagacgtcatgatccgcccttctcttgaatcattcagctcaagttcttttgccaacattgatcatatgatcacagcgggcgaagaagccgcagaccggatgatcggccggattaaacaagaaatagagaactgggagggctaactcatatgaaagcaaaacattttcgctgggtgtttatcatcctgatcttattaatcgctgttacatttattaagcttccgtattacatcacacagccgggagaagcatcagagctgagaccgctgattaaggtggacggaggctatcctgaaaaaggaagcctttccttgatgactgtcaaagtaggccccgccaatccgtatacatatctttgggcgaaagtgcatccttacgatgaaatcgtccctgacgaaagcataaaagaagagggcgaatcggactcggattatatgaagcgccagctgcaaatgatgaaaagctcccaagaaaacgcggtcattgccgcttatcaaaaagccgggaaacaggtgaaatactcatttaacggcatttatgccagctcagtcgtctctgacatgccggcaaaaggaaaaatagaggtcggtgataaaatcatcagcgcggacgggaaaacatacgaatccgctgaaaagctgattgattatatcagcagcaaaaaagcgggggaaaaagtaacgtttcacattgaacgggacacgaaagaaaagaccgttgacattgtgctgaaatcattcccggacgacccgaaaagagcgggaatcggcgtcgcgttatatacggaccggaacgtgaaagtgaagccggatcttcatttcagcattgaaaacatcggcgggccttctgcgggtctcatgatgtctttagaaatttacaaccagctgacaaaacctgacgaaacaaaaggctataatatagccggaacggggacaatcgacgtggacggcaaagtcggaccgatcggcggaatcgatcagaaagtcgtcgccgcagacaaagcgggaaaagatattttctttgcgccgaatcaaaacggagctgaaaattctgattacaaaaatgcggtaaaaacggcgaaagcaatcaagtccgatatgaagatcgtccctgtcgacaccatgcaggacgcacttgactatttggatcagatgaaagtaaaaaacacctgatacagtcaggtgctttttttacgcattcaaaaaacgcttttcgtcttcatcatagcggatcggggcttgtgaaaattcctgcttctcaaacaatgtgcgttcaggttcttttatcggcaggctgtaaacccgtcccgccagtatgtccagatccagagcgggatgagagaaagaagagagcttgctgacgagaggtgcggtaagctcttttttctttgccgacaagtacgcctgtccttttttcgtcattccgagaagacggatataaggagcgcttgaaggctgtaagagccgatgcatgtcctcctttttcgtccgtgtcagaatgtgcgtgttcatccgctgcagcctcgtccacgtgtatcgttttgttttcaatcgttccatcatttcgcgataggatcgggcttgtctgatggtgcgcagaattctgtgctcaaggccttcttccacttcatagattcggctcaattcttcagcggacagagtgctgaggctgtattttacatatgaaaaatagtcttcggtgctgtgccatatcccgtatgaatttctgtatgcctccagctcacgcgcagacgcttccgggagaaagctccttgcggccgccgttcctttttctatcagcgctttccggatgcttgttgcgctggctatccggctgttatctccgggaagctcggcgtcatgatactgggaagcgattctggctgtcgtataaggcttcatagcggaaccgaaggcgtgtatcgctctaacgtagtgaaaaccgagaatattgttcggcttggacaaatcgagcatgtcccgccctctgaatatgtgtgaaaaagcttttgaggcggcggccggatagctgagaccctttttcagctcctctttcagaatcaggctgcagtcatcttcctttcggctgaacgcttcagacgcttcaataaagggttcgatccgcccgttttcgctgccgaaaaacaagctgctgcatcctaaatgatgaagaagcgaaacgctgccgcgcgcgaataattctgctttttgtacggcatacatataagggagctcaatgacgatatccacgccgttttccagcgccatttttgtccgggcccactttgagacggcggccggttctccgcgctgcaaaaaagggccgctcatcaccgccgccgcgacgctgctgtccgttttgatttttgcttgttccgcatgatagcggtgtccgttatgaaagggattatattcaacaaccaggccgactgctttcatatttgtcccgcctttcttgctatgttttgcttcgtgtggtacatttgcaaatgaagtgcatattttagtccgtttcgtttagtgtatgcatagcctatccggctgtcaacgattgcatgacggcggcattatgctgtaaagaaaaaatattgacaaaaacattctgaaaagctataatcatgtttgttgctttcctgaggtgatacaaatgaaatggacgatttatcagcttcatcaaatggcgaaaaagagctttgaatttgatgaaacagttgagttaaatgagctgacaaaattgaattctgacatccgccgcatttctcccgtccgggtgaagggccgcgcggagattgaatccaagcaagtttcgtttgactttacgatttcaggcgaaatggttttgccgtgctcaagaactttagttgatgtgccgtatccatttacaatcgcgacaaaagaactgtttagatttcataagtcggatgatatagaagatgaggacgttcatattgctgaagacgatatcgtcgacttaactccgatcgtaaaagaagagattcttttagaaattcctatgcaagtcttttgtgaaactgaacaaaaagaaggagccgctccccaagtggggaaggattggcaagtgatttctgaggaagacaagaaaaatcaaatcgaccccagacttgcggatctgaaaaagctcttaacacaagatgatgaatcttaactctttaaggaggtgggaataatggctgtaccttttagaagaacttctaaaatgaaaaaaagattgcgccgtacacatttcaaactaaatgtacctggtatgacagaatgcccgtcatgcggagagatgaaattgtctcaccgtgtatgtaaagcatgcggatcatacaacggcaaagacataaatgttaaaagcaattaatgtatgaagaaaagcgcgggaatctcggttcctgcgcttttctttttttttgcccctccggcctgcttccgccgaaaaaattgtgagcgccagtagtctatctaatctatcagcggcatatgtatgaggtaaatgagcaaatatggagggagatacgattgacgataacgagacaagacgcgtggacgcaagatgaagatttgctgctggccgaagtggtgctcaggcatattcgggaaggcgggacccagctttccgcttttgaagaagtcggcagagcgctgacgagaacggctgccgcctgcgggttcagatggaattcttatgtcagaaaacaatatcagtcagggatagaactggcgaaaaaacagcggaaggaattaagaaagcagatcggggtgcattccgccaatctgccgggaaccgtcaaacagcctccgatccgcagggcggaaggagaaaaagagctgtccattgatgatgtcattttgtttcttcagcaatttaaagagtcgccggccgcagcggatgtgcgtcatgaaaaagaaaaactcacagaacagctgaccgcgctgcaaaaagaagtcgaggatctgcgtgaggaaaatgaaagcttgagaaacaagctggagatgacggaagaagattataaagcgctaattgacattatggacagagcgagaaggatggtcaattcaaaagaagacgacagaaaatcggcgcagagcctgtaaaatgaaccggcctgggggcggcggccccgccggttttttattatgccgtttctccggatgtcatttcaccgtccatatcgggatgccagatataaggattttctcctttatcacgcgccatatcatatttaacgggctcaaaattcatcttatcccagaaatctgctgatttcatgcgtgaatttgtcctgatcggcattctgaaggattttgcaaaatcaacaagcgcttttccgtatccgttattttgatagcccggaagaacctcaagcttccaaagttccaaaaagtcctgacgctgatcaaaatacggattcgcacctccgtttacctgatataaactcattctcgccactagtttatccccgaagtaaatcccgtaaaaaggcgaggtgctgtcattttcaatgatattatcctgaagatcttcaagcatcgacagctcctgcatcccgtattccttaaaccttttaaattcttcgagtgtcttaaagttgatgagcagtcgctctattttcaacacaaactccccctttgttgtgttctaccattattgtaaacgctttaattgaaaattccaactataatatgcttgccagtctttttgctcaaaacgaaattgaagtaatttgcggcggcttctgctatgataatatggaaaaatgcagatatagggtgtgacagtgtgaaaatcggaattatcggcggcggagcggtaggccttttatgtgcttactacttatcgtcccgccatcaggtaacggtcattacgcggcggacggagcaggctgatgcgattaactcaggcggtatacgacttgtgaaagacggaatagaatgtacggcggcatgcagagcgcaaacgggcatcacttccggattcgacctcttaatcgcagccgttaaacagcaccagctcagtgctgtgctgcgggaccttgagacgataaaagggacgaatgtgctgtttttgcaaaacggcatgggacacatacacgacatgaaagattggcatacggatcattcgctttatgccggcactgttgagcacggagcaaaaaagatatcagatcatgccgttgaacatacgggagcgggagccgtaagatggagtgaattcagcgcatcccggccggaaacgctcaaaagcatcttttccggcatgcaccgcgattttcccgtatatgatgaaaacgactggtatcggctgttaacgggaaaactgatcataaatgtatgcatcaacccgttaactgcattgctgcgcgtgaaaaacggagagctgttaagaaatgacgcttacaaaaagtatatgagaaacgtatttgaagaagcggagacaatacttggcctcgccgatagagaaaaagcgtggaacaaggtttgcgaagtgtgcagactgacggaaaaaaatcattcttccatgctcgtcgatatcatggcaggcaggcggacagaggttgatgcgattatcggctaccttgtaaaagaagcggaaagccgcggattgccggccgttcatctcacgtttttacaccgcagcataaaagcgttagaaagaaactgaaacaaagtcttttgaggttttccggtaacatgctatactcatttcggaaacctaactatttattggagaaaggaagttccagacagatgcagctaactgaactttccatcaaaagtcaaaataagtttgtgcagcactatatagatggagaaaacatgtcttcattttttgattatgatattcattcagaggacgtatggcaaaagcggcttcatgacttgtcttcgcggccgtttgccagagaggaattagcggattatttatcctcctatcacgaaaaatttcactccgccgccatgcaggcctccatcgaaaaactgagagatccaaaaagcgcagcggtagtaggcggccagcaggccggtcttttaacggggcctctttacaccatacataaaattatctccattatcgtacttgccagacagcaggaagaggcgttacagattcctgtcgttccgattttctgggtggcgggtgaagatcacgatctggaagaaatcaattttgtgcatacgtcaacagagaataaaggtccggtgaaacagaaactgccgcagtcgtactggaaaaaaacatcggcggctaaaaccgagcttgatcaggaaaaatgcgcggcttggattgatgaagtgttcgctgcttttgaggaaacggatcacacaaacacactccttcaaaacgtgaagcgatgtttacgctcatcagagacattcacggacttttttgagctgttgatcgccgacttgtttcaagaagaaggccttattctgttgaattcgggagatccggggattaaaaagctggaaacgggtatgtttcagcagattttaaaacacaatcatgagcttgccaaagccgtttcagaccagcagcgttttatgcgggaagccggttatcacccgattattgaatcggacaaagatcaggccaatctgttttacgaacatgagggagagcgtttcttaattgaaaaagaaaacggcgtttttatgattaaagagcttgacctgaagtggacgaacgacgagcttcatacccatatggaagaaaaaccggaatgtttcagcaataacgttgtgacaaggccgcttatgcaggagtttctcatcccgactctggcgtttatcgcgggaccgggggagatcaattattggggggagctgaagcaggctttctcattaatgggctttcgcatgacgccggtagtgccgagactgaacattacgattcttgagcgccatattgaaaagaagctttcagaacggaatatcccgcttcaggaagcgatcgaacacggcaccggacacctgaaagacaattattttgaagagcagattccggaagagttttcttctgtaatggagcaggcgaagtcgcagattgaagctgtccataaaagcgcaagggacgaagcgctgaaggtcgattcaagccttgagccgctcttacagaagaatgccgctttcattcaagatcagctcttgtttttagaacggacggtaacgaaaagaattgaagaaaaagaaggctttgtgctgcgtgactatgaaagaatccaaaacagcatcagaccgctcggcgctccgcaggaacggatttggaatgtgatgtattatctgaaccgctacggtccaaaattcttcacaaccttcaaacatctgccattttcttttcaaaaccaacatcagattgtcaaactttgaaataaagttttaaagaaccctgaatagttcagggtttttttttatgtgtaaacagtgtaaaatgaggttgtggagagaagtggcggatagtggtgagtttaggggagaaagtgggggtccttatcatgtttatgggtgaataccggcataccgttgatgcaaagggccgcatgatcgtacccgcaaaattcagagaaggcctcggtgagcagtttgtgctgaccagaggactggaccaatgccttttcggctatccgatgaatgaatggaagctgattgaagaaaagctgaaggctctgccgctcaccaaaaaagacgcccgcgcatttacccgattctttttttccggtgcgaccgaatgcgaactggacaagcagggaagggttaatattgcgtcatctcttctgaattacgcaaaactggaaaaagaatgtgttgtcatcggggtttccaatcgaattgaattgtggagtaaggtaatatgggaacaatacacagaagagcaagaagattcattcgctgaaattgctgaaaacatgattggatttgatatataatggatcttcgtgcatcacaacaacaactgacaattcaattcattcctgataaaggtgggaccgacacaaatgtttcagcataagacagtacttcttcgtgaaaccgtcgacggtttaaatatcaaaccggacggaacctatgtggactgcacccttggcggcgccgggcacagtacatatttattgcagcaattatcggaaaaaggacgcttgatcgcctttgaccaagatgacacagcacttgaaaacgcaaagaaaacattgtccgaatacaaaggacagcttattctggtgaaaagcaactttcgttatttaaaagagtgtttacatgaacacggcattacgagtgttgacggaattttatttgatttaggagtatcctctccgcagcttgatacaccggaacggggattcagctatcatcatgacgcaccgctggacatgaggatggaccagtcggccgcccttacggcgaaagaagtcgtaaatgaatggcggtatgaggaccttgtgaggattttctttaaatacggagaagaaaaattcagcaagcagatcgcccgaaaaattgaagaggctagagaaaaatcgcctattcaaacaaccggccaactggtcgatctaataaaggacgcgataccggctccggcgagaagaagcggaggtcatccggccaaacgtgtattccaagccattcgaatcgccgtaaacgacgagcttcaagtatttgaagaggccctcttgcaagcgatagaggtgctgaagccgggcggaagggtgtctgtgatcacttttcactcgctggaagacagaatgtgcaagacgacattcaaggaaaaatcatcacttcccgaactgcctccgggtcttcccgtgataccggaagaatttgaaccggaattaaaactaattacgagaaagcccattacggcatcaaaagaggagcttgaagaaaataaccgcgcccggtcagcgaagctccgcattgcggagaaacgaaaataacgggcagcaaatgacaacattaaaggaggtcatcagcctatgagcaacttagcttaccagcaggaaaaacaacaacggccagtgataagtcccgaaaaaaaggtgattgtcaaaaagagggcttccattacactcggggaaaaggtgctgctcgtcctgtttgccattgccgttctctccacatcaatgtttatcgtatcaaaggcatacgcggcttaccaatctaatattgaggtgcaaaaactggaggagaaagtatctgagcagaataagcagatcggtgatctcgaaaagacggctgctgacttaagccagccgcaacgcctgatggatatcgccaaaaagcacggtttgaatctgaaagataaaaaagtgaaaaacatacaggaatgataacccatgccgaaaaaaaataagtttatgaacagaggagcagcgatactcagtatttgtttcgctctctttttctttgtcattctcgggagaatggcgtacattcaattaaccggtaaagcaaacggtgtagaacttgcaacaaaagcgaccgagcagcacgaaaaaaagcggacgatagaagcgagccgcggctctatttttgaccggaacggcaaagtgcttgcagaggacacggcgacatataagctcattgccgtgcttgataaaaagatgacgaccgacaagaagcatcctcagcatgtcaaagacaaagagaaaacggcggaaaagctggcgaccgttatcaatcttgataaaagcgagattctggacatcttaaacagggatggcgcgaagcaggtggaattcggttcagccggccgcgatatctcttatgcgaaaaaacaaaagatcgaaaaaatgaatcttccgggtatttctttcttaagagatacgaagcgctactatccgaacggtgtatttttgtcaaatgttctcggctatgccgatgtgaatgaaaaaacaaacgagatacagggctctttagggcttgaaaaaatactgaataactatctgacggaacgcgacggatccgtcacttacgaaagtgataaatccggctggaaacttccgaacagcaaagaaaaaatcaccgcacctaaaaacggtgacaatgtatatttaaccattgatcagaaaattcaaacttttttagaagacagcatgacgaaagtagcggaaaaatacaaaccgaaaaaaatcatggcggctgtcgtagaaccgaaaacaggcaaagtgctcgcgatggggcagcgtccgagttttgacccgaatatcagaaacgtcaccaattattacaatgacttagtgtcgtacgcgtatgaaccgggttcaacgatgaagatctttacgcttgccgcggcgattcaggaaaatgtgttttctgcaaacgagaaatataaatcaggaacatataaagtgggaggcaaacctgttaaagattggaacgaaggcgccggctggggtatgacaagcttccgtgacggcctcatgaggtcatcgaatgttgctttcgccaaactggccaacgaaaaactggggtttgaccggtttaatgagtacctgcacaaattcgggctctatcaaaaaacagggattgatctgcccggtgaagtatcaagtaaaattaactacaaatatgattttgacaaagcgtctacggcttacggccaagcatcggcgataacgccgatccagcagcttcaggccgtcacggcgattgccaataacggcaaaatgatgaaaccttacgtcattgatcatattgtcgaccccgatacgaaaaaagtcgtcaagcagacaaaaccagagcaagtaggcacgccgatttcagccgatacggcgaaaaaagtccggaacctgctcggagaagtcgtgacgtcagacatcggaacgggaaaaccttataaaattgaaggatttgacgtcgcgggtaaaacgggaaccgcgcaaatcgccgggacgggcggatatttaaagggaacgagcaactatgtgttttcattcatgggcatggcgccgaaaaatgatcctaagctcgtcatctatgtagccgtgcagcagccgcaattaaaagcgggtcaaagcagctctgatcccgtcgcggaaatctttaacccgacgatgaaaaacagcctccactacctgaatatcgaaccgacggaaaaaacagattccggtcaggaagaaacgaaaagccaaaagatgcctgacctgacagataagacggtcaagagcgctgagaaggaagcgaaaaatgaacatctcacaccgattgtcatcggcagcgatgttgccgtaaaagagcagtatccgacagctggagaagatgtgatcaccaatcagaaaatcttcttaaaaacagacggaaagatgacgatgccggatatgtccggatggtcgagacgggaagtgcttcaattcagcaaagtatcaggcattcacattgatgtgagcggtgaaggttacgcttcaagccaaagtgtgaaaaaaggcaaagaactgaaagaaaataccgtgatcaaggtgaaatttaaaaatcctgattaacgggacagagaagtccgcggatgcccgcgggcttcttttttatgcgccgccgttctatgtgtccaagctgaggcataaattgaaacaagcctaaataaggagtggacggtcccttgcgcgtttcaaatgtaacggttcgaaaacgtttattactggttttgctttttggcgtaatcatttttttgatcattgacagcagattaggctatgtccaatttgtgatgggagaaaagctgacttcactggctaaggattcctggagccggaatttgccgtttgagcctgagcggggagagattcttgaccgaaacggcgtgaagctggctactaataaaagcgcgccgaccgtctttgtcgtaccgcgccagatccaaaatcccataaaaacgggcaagcttctcgcgtcagttttaaatatgtcggaagagaaggtctacaaacacattactaagaaaacctccatagaaaaaatctcacccgaggggcggaaaatttccaataaaaaagcgaaagaaatcaaagcgctagacttaaaaggggtttatgtggctgaagacagcatccgccattatccgtacggaagctttttgtcccatgttctcggttttgccggtattgataaccagggccttctcggattggaggcttattatgatgatgacttaaaaggtgtcaagggatctgtgaaattttatacggatgccaaggggaagaaaatgcctgatgaagcggatgattacacccctccgaaagacggacttgatatgaaattgacgattgacgccaaggttcagacgattatagaaagggagctcgacaatgcagcggcgaaatataacccggacggaatgattgcggtcgcaatgaatccgaaaaacggggaagtgctcggcatgtcaagccgtcctgattttgatccggctgactaccaatcggtggatccgtccgtttacaaccggaacctgccggtatggagcacatatgaaccgggttcgacctttaagattattacgcttgcggcggctctccaagagcaaaaagtaaacttgcaaagagaccacttttatgacaaaggatttgccgaggtcgacggcgcccgcctccgatgctggaaaaagggcggccacggttcgcaatcttatcttgaagtcgttcaaaattcctgcaaccccgggtttgtacagctgggggaacggctcggaaaacaaaagctgtttcaatatattaaggacttcggctttggaaagaaaacaggcattgatctgcaaggggaaggaacggggatcttattcccgcttgacagagtcggcccggtcgaacaggcgacaaccgctttcggacaaggggtttccgtcacgccgattcagcaggtggcagccgtttccgcggcaataaacggcggaacgctttatactccgtttatcgccaaagagtgggttgatcccgttacgaaaaaaaccgttaagaaacaatcgccgattgcgaaaaggcaagttatttcccaggaaacgtcaaagcagatcagatatgctttagaaagcgtcgtcgctcagggaacggggcggaatgcctttgtggaaggatatcgcgtcggcggaaaaacaggtaccgcacaaaaggttaaagacggcaaatatctcgaaaacaaccatatcgtctcctttatcggttttgcgccggctgatgacccgagccttgtcgtatatgtcgcggttgataatccgaaaggtacgattcaattcgggggaaccgtcgccgcgccgattgtcggaaatatgatgagagacagtctgcctgagctcggcgtcaaaccgcgaaaaaatcaaatcgagaaaaaatatcaatggaacgacacaaaaacaatagaggttccgaatgttgtagggatgtctgtctctgatcttgagtcgctgcttgtcaatttgaatatagactcctcaggaaaaggaagcaaaattgtgaaacaatcacctgcagccggaacgaaagtaaaagaaggctcaaagatccgtgtttacttgagtgaagaatgagtctttttgaggcagccgattgttttcggctgcctcttatcataaagagaaaaaaagaagataacttttaagattaactggatgtatccttttatttacgctaaaatatgaactgtatgtttaaaagccattctgacttttataaacggttatcatgataaaagaatgaatagaatttctgagaggtttgatacaatgaaacttacaaagctgcttacatatttaatggccgaacctgttcaaaatgactttcatgaccctgacataacttcaattgagatggactccagggaagtgagaaaagggagtctttttgtatgtataaaagggtatacggtagacggacatgatttcgcccaaaaagccgcagaaaacggcgcagcggccatcgttgccgagaaagagcttgacgtcgatgttcctgtcattatcgtccgccggtcacagcgggcgctcagcgttctttctgacgcgttttatgggcagccgacaaagcagcttcagcttatcggcatcaccggcacaaacggcaaaacatcaacgacgcacatggttgatgagattttcaaaaaagcgggaaggcagaccggtttaatcggaacgatgtacattaaaatcggggatgagacattcccggtcaaaaatacaacgcccgaaagcgtcacactgcaaaaaacgttcaagaaaatgaatgatgagcatgttgacacagctattatggaagtgtcttctcacgctctgtcactcggcagggttcacggctgcgattatgatatcgccgtattcacgaacctgacgcaggaccatttagactatcacaagacgatggaagactacagacaggctaaaagcctcctgttttcccagctgggcggctcctttaaccacgaaaagccgaagcgggccgttttaaacgcagatgacaaagccagtgcttattttgaaaaagtgacggcggcgcacatccttacatacggaatcgagaacgatgccgatgtcatggcgaaacaaatcgagatctctgcgcaaggcacaagctttgaactcgttacgccaaaaggaacaaagcagatcacggtttcactcgtcggccgcttcaacgtgtataacgtactggctgcagcggcgacagcgatcgcagcgggactgccgtttgatacgatcgcaagcgctcttgaagagcttcaaggtgtcagaggccggtttgaactggtgaatcataatcagccgtttcctgtggtcgtcgattacgcgcacacgcctgacagtctggaaaacgttctgaatacatgtaaagacatgacagagggcaagcttttcgtcgtcgtcggctgcggcggagaccgggacaaaacgaaacgcccgaaaatggccgaaattgcggtgcggattgccgacgaaccgatttttacttcagataacccgagaagcgaggacccgctggccatattaagagatatggaaagaggggtagaaggcacctactatcacagtatcgcaaaccgcgagcaggctatcttttttgccattgccaacgcgaaaaagggagatgtggttctgattgccgggaaagggcatgaaacctatcagcagatcggcaatgaaacattcgactttgatgacgccgaagtagcgggaagagctattgttgagctgaataaaaagtaaaacaggaaagagtgttagaatgagggaaatgaaaagaattacggggacacaatgtgaatatgataaatacgtatgtcgtttgaacgaaacgggaggagaaaagagcaatgcttgagcaagtgattttatttacaataataatgggatttttaatcagtgttctgatatctccgattcttatcccgtttttaagacgtttaaaattcggccaaagtatcagggaagaggggccgaaatcacatatgaaaaaatcagggacgccgacgatgggcggggtcatgattatcgtatccatcgccattacggcgattgtcatgacgcagaaattttcgcatctgagcgcggaaatgtttcttctgctgtttgttacgatcggatacggcctgctcggctttctggatgactatattaaagtagtaatgaaacggaatctcggattgacgtcgaagcagaaattgatcggccagatcattattgccattgtattttacggagtatatcattattgccatttttcaaccggcatcagggtgccgggcacacatctgtcaatcgatctcggctggggatactttatcctcgttctctttatgcttgtcggaggttcaaatgccgtcaacctgacagacggtctggacggtctcttgtccggtaccgcggctatcgcattcggcgctttcgccatccttgcgtggaaccagtcacaatatgacgttgcgattttctcggttgccgttgtcggcgccgttctcggttttcttgtattcaacgcccatcccgccaaggtatttatgggggataccggttcgcttgcgctcggaggagcgatcgtgaccgttgccattctgacgaagcttgaaattctgctcgtcattatcggcggagtatttgttattgagaccttatctgttatcttacaagtcatcagctttaaaacgacaggaaaacgaatctttaagatgagtccgcttcaccaccattacgaattggtcggatggtctgaatggagagttgtcgtcacattctggactgcgggactgctgcttgccgttttaggaatttacatcgaggtgtggttataagtggaaaacgaactttttttgcaaaaacaaaactttctggtcctcggactggcgaaaagcggatatgcggctgcgtcgattcttcatgaaaaaggcgttaacgtcgtcgtgaatgatcaaaaagcctttgaagagaacgaacctgcccaaaggcttgcagaaagaggaattgaagtcatctgcggtgagcatccgacgtcactttttgatcagcatcacattaccattctgatcaaaaatcccggaatcccgtatgaaaatatcatggtggaggaagcgcaaagaagaggcatcccggtctggacggaaatcgagcttgcgtattatatcaccaatgcaaaattcatcggcattacaggttcaaacgggaaaacaacaacgacgaccctgatttatgaaatgctgaaagctgactcgataaaggcgctgatcgcagggaatatcggcactgtcgccagtgaagtggcttatcatgctgacggtgatgaatggatcgtcacagagctttcttcgttccagcttatggggactcatgcgttcagacctgaaatcggcctgattttaaatgtgttcgacgctcatttggattaccatcacagccgtgaaaactatgaaaaagccaagcagaacgtgtatcttcatcagcttgagagtgatacggccatcgtgaatcaaagcgatgaaacagtcgtgcggcttgccgaaagcggaaaagccggcaccgttccgttttcagttcaccaggaactgtcaagcggcgcattcattaaagacggaatgctgatgttcggcgatgaagcgattctgcctgttgatgacatcgtactgccgggcgcgcacaatttagaaaatatattggccgctgtagccgcggcaaaaacggcgggcgcgtctaataaagcgattcagaaggtgctgacaagctttaccggtgtcaaacaccgtctgcagtatgtaactgcgatccagaatcgtaaattttataatgacagcaaagcgacgaatattttggccacaagcaaagcgctctccgcgttcaaagctccggttattctgcttgcaggcggactggaccgcggcaacggttttgacgatctgaaaccgtatatggacaatgtcaaagcggtcctgacgttcggacagacagcgccgaagatagaaaaactgggcaatgagctgggaatacaacatgtcaaacgtgtcgataatgttgaacaagcagtatctgcggcgtttgcgctctcaaatgaaggagacgtcatcctcttgtcacccgcgtgtgcaagctgggatcagttcaaaacatttgaagaacgcggtgacatgtttatagatgccgtgcatatgcttaagtaagggcttgtctctgttcatcggcagccctaaatgacttatgcttggggtgtcgattgctttgactactaaaaaaacagcgcctgatttgttattagttatcattacgttattgcttttaacaataggattaattatggtctacagtgcaagtgcggtatgggcggattataaatttgacgactcgtttttcttcgcgaaacggcagctgctgtttgcggggatcggcgtcattgccatgtttttcattatgaatgtggattattggacatggcgcacatggtcgaagctgcttctgatcatttgtttttttctgcttgtgcttgtgctgattccgggagtcggaatggtgcggaacggttcaagaagctggatcggagttggagcgttcagcattcagccttcggagtttatgaaactcgcgatgattgcgtttctggctaaatttctttctgaaaaacagaagaacattacgtcattcagacgcggattcgttcccgcgctcggaatcgtgttttctgcatttattattatcatgtgccagcccgacctgggaacggggacggtaatggtgggcacgtgcatcgtgatgatttttgtttccggtgcgcgaatcgctcatttcgcgtttctcggactcatcggtttaagcggatttgcggcgcttgttctgtccgctccatatcggattaaacggattacctcttacttaaacccgtgggaggatccgcttggaagcggatttcagatcattcagtcgctctatgccgtaggtccgggaggtctgttcgggatggggctgggtcaaagccggcaaaagtttttttacctgccggagccgcaaaccgatttcatttttgctattttatctgaggaactcggctttatcggcggttcgctcatattgctgctgttcagtattttattatggcggggcgtcaggattgccctcggcgcgccggatttatacggaagctttgtcgccatcggtattatttctatgatagctattcaagtcatgattaatatcggcgttgtgacggggctgatcccggtaacaggaattacgctgccgtttttaagctacggaggctcatcactgacgctgatgctcgcagcggtcggcgtgcttttaaatgtcagccggtactcgaggtattgatctgtatcttgcctcatcactcatgatttattcgttatctataaaaaaacagacaacatcaataaccctgtcctaaaaaacagggttatcgctatgtgattaagggggacatacgaatgcgtattgcagtaagcggaggcggaaccggaggacatatttatccggccctggcctttattaaagaagttcagcgccggcatccggatgtggaatttttgtatatcggaacagagaacggccttgagaaaaaaattgttgaacgggaaaatattccgtttcgcgccattgaaattacaggtttcaaacgaaaactttcttttgaaaatgtaaaaaccgtcatgcgtttcttaaaaggcgtgacgaaaagcaaatcatatttaaaagagtttaaaccggatgccgttatcggtacaggcggctatgtatgcggtccggttgtatacgcggcggcaaaaatggggattccaacgatcattcatgagcaaaacagcctgcccggcatcacaaataagtttctctcgaaatatgttaataaggtggcaatttgctttgaagaggcaaaatcgcattttcctgctgaaaaagttgtgtttacgggaaacccgagagcctctgaagtcgtctcaattaagacaggccgttcattaactgagttcgggctgaaagacaatcaaaaaacggtgctcattttcggcggaagcagaggcgcggctcccattaaccgtgccgttatagatatgcaggaagaattgaaaacgagaccttaccaagtcctttatattaccggggaagtgcattacgagaaggtaacggctgagctgaaaggcggaaaagccgctgataatatggtgacaaaaccgtttttgcaccaaatgccggagtacttacaatcaattgatgtcattgtggcaagagccggagcgacgacgattgcggagatcaccgctctcggcattccgagcgtgcttattccgagcccgtatgtgacagccaatcaccaggaagtcaatgcgaaggcgctcagccagcatgacgctgcaatcgtactgaaggaaaccgagctcagcggagaaaaactgatcgctgcgctggacaaaatcgtcatgaatgaagaaaccttaaaggacatgagtgagcggacaaaatcactcgatgttccggatgcggcagccagactgtacagtatcatgaaagacataaaaaaatagagcaaatggaatgcggaggtttatgatggagaacgtaattcaggaattaagagaccgcgaagtcggcaaagtgctggaacaagaaccgctcgcgaaccatacaacgatgaaaatcggcggtccggcggacattttgatcatccccaaccgtgtggaagcggtcaaagatattatggatattgtgaagaaacatgatctgccatggacggttatcggccgcggttcaaatctgctcgtgcttgatgaaggcataagaggagttgtcatcaaactgggcgcgggtctggatcatttggagattgacggtgatcaagtgacggtcggaggcggctattcggtcgtccggcttgcgacttccatgagtaaaaaaggaatgtccggtctcgaatttgcagcgggcattcccggatcaatcggcggagccgtctatatgaatgccggggcgcacggatctgatatgagtgagattcttgtgaaagcccgtatcttatttgaagacggcacaatcgaatggctgacaaacgaagagatggatttcagctacagaacgtctgttttgcagaaaaaacgccccggcgtctgtctcgaggcagttcttcagcttgagcagaaggaacgggaagccattacggcgcaaatgcagcagaacaaagattacagaaaaaatactcagccgtattcaagcccctgcgccggaagcatattcagaaatccgctgccgaatcatgccggaaacctcgttgaaaaagcgggattaaaaggacatcagatcggcggagcgaaagtatccgaaatgcacgggaattttatcgtcaatgccggcggagcgactgccaaggacgttctagacctgattgagtatgtgaaaaagacaatccgtgagcagtatgatgttgacatgcatacagaagttgaaatcatcggagggaatcgttaaaaggttctctgattacatgagctcatgtgatatacttttaacaaatgtcaaacggcatcacagcatgccgtttgtttttcaatcagacgaatgtcaagctgtttcattcttagtgaggtggacaggcagtgaacccaaatcatgaaagagaaaaaatcgtaaatattgaagagcggattccgaaaatcaaagagcagcggaaacaaaaagcaaaccgccggctgatttcattcattgtgctcttttttatgatggtgctgatcatcgtgtacttgcagatgccgatcagcaaagtgtcttctgtcaccgtttccggaaacgaaaacgtttctgtaaaagagatcaacgcgctttctgatatacataacggacaaaccgagttctggagtctgaacaagaaacaaacagaagaaaagattgagcagaataagctggtgaaaaaggcggaactttcaaaagtatttcctaacaaagtcagcattcacattgaagaatacaagacgatcgcgtatctgcagcgacatgatgtgtattatgaagtgctggagaacggcactgtgctgccgaacgaagtcacaccggatgacgcgggcccgattttggttgactggacaaacgcgaaaaagcgggtcaaaatggcggagcagcttgataagctttccggttcgcttaagcagtcgatttctgaaatctattatacaccggtaaaaatggatcaggaccggatcaagctgtatatgaacgacgggtatgtagttaccgcttctattaaaacgtttgccggccggatgaagacctatccttctatcgtttcccagctggacggcgggaaaaaggggattatccacttagaagtcgctacgtattttgaagaatttaacaaaggtaaatccggcaagaaaaaagaaaatgattaatagttctaaagaactaatttaaaggtgattcaaaagaatctattacaatcagcggggcagccgatataaccgatagcggaatcattatgactatgtttgtttttgcccgggatatggctgccggacaagcggaaaattctcaatgcaatgggcgtgtcttctgcaatgagcattgcatttggaattttcctcctgtttcttcttttttcggatgtttctggcaatatctatagcttttctggaggttcatcttagtgtagactaatggaaagcgggtatatttgcatctggtttgcacattatggcaccgtgacaggaaatcttacggtaaggtgggccgtctctaaaaaaaataaaaaaaatgcgatataaaagaggatatacatagaatataacgaatagtttcattaaacataaattgtgagaaatcagataagaatttgttgatgctgttgtttttgttacacacttgtaaagccacattcattgtattgttgttccgcaaataatagaatagaatttgatcgaaatgtgaggaggtgccatagaatgaacaacaatgaactttacgtcagtcttgacatcggtacgtccaatacaaaagtgatcgtcggagaaatgacagatgattcccttaacattatcggagtgggaaatgtaccgtctgaagggttgaaaaaaggctcaatcgttgatatagatgaaaccgttcattctataagaaaagcgtttgaccaagctgaaagaatggtaggttttccgctgaaaaaagccattgtcggcgttaatggaaattatattcatattcaagatacgaacggcgttgtcgctgtttccagtgaaaacaaagaaattcacgttgaagacgtccgcagggtaatggaagcggcacaggtcgtgtcagttccgcatgagcagctgatcgtagacgtcgttcctaaacagtttatcgttgacggaagagacgaaattaccgatccgaaaaaaatgctcggcgtgcgcctggaagtagaaggcacgctgattaccggctccaaaacgatcttacataatttacttcgctgtgtggagagagcgggcgttgaaattactgatatctgcctgcagccgcttgcggccggttcggcggctttgtcaaaagacgaaaaaaacctcggagtcgccatgattgatatcggaggcggctcgacgacggtggcggtatttgaacagggacacctgaaggagacagccgtcattccgctcggaggcgaaaacatcacgaaagatgtatcgatcggattgcgcacttccaccgaagaggctgaaagagtaaaaaaacaattcggacatgcattctacgatgaggcttcagaagatgaagtatttgaagtcaccgtcataggaacgaatcaaaagcaatcttttacacagcaggaaattgccaatattattgaagcaagagtggaagagattcttgagattgccgcagccgaaattgagcatatgggaattacagatctgcccggcggctttgtgctgaccggcggacaggccgctatgcccggagtgctttcattggcacaggaagtgctgaggcacaatgtaagggtcgcaagcccgaattatatcggtgtaagagaccctcagtatatgacgggtgtcggcttgatacaatttgcctgccgaaatgccagaattcagggaagaaaaataggctttcatatgccggaagaagccgtgcaggaaatcgcggtctctcacgaagaagaacatcatcagcggccagaggcgcagcagcgtccaaaagcaaaacaaaaaacacaagccgaacacaacaaaccgagcaaaatgaaaaaactattaagcatgttttgggaatagattgatagtcattcggcagattaggaggatttagcatgttggatttcgaaacaaacatagacggcttagcatcaattaaagtaatcggagtaggaggcggcggtaataacgcggtcaaccgaatgattgaaaatgaagtacagggtgtagagtacattgcggtaaacacggacgcgcaagctcttaacctgtcaaaagcggaagtgaaaatgcagatcggggaaaagctgacccgcggtctcggagcgggagcgaatccggaagtcggcaaaaaagccgctgaagaaagtaaggaacaaatcgaagaagcgctaaaaggcgctgacatggtgttcgttacagccggaatgggaggcggtaccggaacgggagccgcaccggttatcgcgcagatcgcaaaggacttaggcgctttgactgtcggtgtcgtaacaagaccgtttacatttgaaggaagaaaacgccagctgcaggctgcaggcggtatcacggcaatgaaagaagccgttgacacactgatcgttattccgaatgaccgcattcttgaaattgtcgataaaaacacaccgatgcttgaagcattccgtgaagctgataacgtgcttcgccaaggggtgcaaggtatctctgacctcatcgcgacgcctggtttaatcaacttggactttgccgatgtcaaaaccatcatgtccaacaaaggttcagcattgatgggtatcgggatcgctacgggcgaaagccgtgctgctgaagccgccaaaaaggcgatctccagtccgttactggaagcggcaatcgacggagcgcaaggtgttttgatgaacattacgggaggtacaaacctgagcctctacgaagtgcaggaagcagccgacatcgtcgcttctgcatctgaccctgatgtcaacatgattttcggttcagttatcaatgaaaatctgaaagatgaaatcgtcgtcaccgttattgcgaccggttttatcgaacaggaaaaagatgactcaaaaccgcagcgcccgactttaaaccaaggattgaagtctcaaagccaaaacgctgcgaaacgtgagccgaaacgagaagaaacacagcatcaaaacacggcgaaccgccatacatcacagccggcggatgatgccctcgacattcctacatttttaagaaaccgcaacaaacgcggctgatgtaaaaaaggacaagaccacatggttttgtcctttttcttttttgtgccagtcttccttcctatccccatgatctatacagtgaaaaaagaaactttatacctatgacgaattgattgttttttagttttatacggctttctacagaatgtgacaatatctggatggaagattgtctacatttaacgtacagcatcgaaaatgacaaacgattccaattatgaaggagggatacacattttatagggcgttaccaaataaggggggatacgattgaagaaaaaaacgagaaacagatggacaggctccgttttaagcgcgattgtcgtcagttcactgttgtttccgggtgcagccggagcgaacagcacaccgggggcagtttctttcaccaaagatctttcttcctctaagagcattcagcataagatttccgattcagtcaagaagcgttttgaaaaaaatgataaagtcacgtttcttatcaaatttaaagagaaagccaatacgaaaaaagcggtcaaagaagcagaaaaaaatgccaagtctcaatcgctttccgcagcaaaaaccgaatatcaaaagcggtcagccgtcgtttcttctttaaaactggcggctcatgatgcgcagcagaatctgaaaacatatttggaaaaacaaaaaaagaaaggcaaggctgatcacatccattcctattatattgtcaacggaatggcagtcactgcttcgaaagaggtaatggaaaaagccgcctcatttcctgaagtagaaaaagttcttccgaatgaaaaacgtcagcttactcaacgacaatcaaaagctccttttcaaatgaagaaaaaacaaaaagagatcaaagcaaaggaaggcatcgaatggaatatcagccaaattgatgcgccgcaggcctgggcctcaggatacgacggaaccggcacggttgtcgcctccattgatacgggagttcagtgggatcatccggcgcttaaggaaaaataccggggttacgatcctgaaaatcccgcaaagccgaatcatgagatgaactggtatgatgccgtgtcccataaagacgctccctacgatgatcttgaacacggcactcatgtaacagggaccatgacgggttcagaacctgacggctcaaatcaaatcggtgtggctccgggggcgaaatggatcgcagtaaaagcattttcagatgacggaggaaccgatgccgatattttggatgccggtgaatgggtgctcgcgcctaaagataaaaacggcacgccgcatcccgagatggcgccggatgttgttaataattcctgggcaggcggttcgggaatggacgagtggtaccgcgatatggtgaatgcgtggagagcggcagggatttttccggaattctctgcgggaaatgaagacttatttacaccgggaggaccgggttcaatcgcgaatccggccaattatcctgaagcatttgcgacaggtgcgactgacatcgacaagaaactcgctgatttctcacttcaaggcccctcaccgtatcatgaaacaaaaccggacatttcggctccgggagtgaatatccgttcttcgattcctggaggaacatacgaaggcggctgggatggaacttcaatggccgggccgcatgtggcggcgacggcggctttgttaaggcaggcaaacgcctctattacggtcgatgaaatggaagacgttttgacgcgcaccgcggaaaagctgacagattccgtttttccggagtcaccgaataacggttacggccacggtctcgttaacgcttttgatgccgtttctgccgtaacggacggaatcggaagcgtagcaggcaaggtctcttctgcgggtgaagatcacaatccgcccagctttcatcatgaaccggtctcagtggcttacaaaggggcaaaccttccgttaacggttacagcagaagacgatgtaagcgtaactgaagtcatcctttcctatcagtttgatgaaggagagtggaaaacgacagccgccgttcaaaaaagcggtgatgaaaaaaagggaacataccaggcggaaattccggatgtaacgggaagcaagataagttataaatggaccataaaagatttcggaggtcattctgtagaatctgatacgtaccgggctgacgtgaaaccgagcgttacggcgggatacaaagaggattttgaatcacagccggcgggctggtccagttacgggacacatgaccaatgggaatggggtaccccgggttcagggcccggcaccgcattttccggagataaagtgtatgcgacgaatctgtccggcccttatgccgattcagccaacatgaatttggtgatgcctccgattcaagttccggaaacaggacggctgtttttacaatttaaaagctggcacaagctcgaagaattttttgattacgggtatgtgttcgttctgccggaaggaaaatcaaattgggagcaggcggccgtttacaatggtgactccgcaggatggaacgatgaagaggctgatttatctgcgtataaaggccaaaacataaagctcatgtttaatatgcagtcagacgaagtactgaatgaagacggatggtatatcgatgatgtccggctttcaagcagccctctcggcaaggcggccaaaaaaaataaacacaaaagacaaacacctcccggccacctgaagaaaaaagccgtcagtccgaaacaggccaaaccggcagtgaaatcacccggaaaaagagtgaaacgtgaaacaaacctcctgccgctcagagcgcaaatcagtgtctccgagacggggaaatccgtatattccgaccctgcaagcggaagctacagcctgtcgcataaggcgggaagctatacgctgaaagccgaggcttacggatttaagtccgcttcgaaacaagtttctattcaatcagacaaaaccgcacaggcagactttacactggagcaaatgccgtccggcacgctaaaaggaaccatcaccaatcagtcaacaggcgaaccggtaaaaggggctgcgctttatgtggctgaggatgccgcaattgaaccggcggtgacaaacgataaaggggaatattcgcttaaggcgtacgaaggctcctacacaatcaaagtagcggcaaaaggcttttacaatagcgaattttccgttgacatcaaaggagatgctgaaaaaaacgtcaagcttaagccgtatatcggttatgaaggggaaattgcctatgataacggaacggaagaagccgcgctgtcatattttaaagccggcagcaaatctgccgtaaagatgacgcttaaagacggaaaagaacacggtatgctgacggaaggcctttttaaattttggggcgccgactggcctgatccgggcggtaccgaattccaagcagaagtatatgatgcatccggccctgatggagctccgggcagcaaaattgccggcccgttccaagctgaagcgcttcgaaacggcgaatggaccaaagtggatctcagctcaaaaggaatcgcggtcggaaagaatttttatcttgtgttccgccagacgaaacccgatccttatacacctgccctgtcatctgatgacggcagtccgtactcgaacagaaactggcaatacctcgacggccgctggtctaaaaccgataaatcagacggaaactttatgatcagggctttggtcgactacgaagcttctgtgcctgacataacgtcgcctgaagaccggtcatttacaaacaagaggtcaatcacggtgaaaggaacggcttcaccaaaaaccgctgtccgtcttaccaataacggtaaaaccgccgcagaaacgaaagcagatgcagacggcaatttccaggccggcgtcacactcactgaagatgccaatcggctgacggcggcatctgtgacagacagcgggtcaaccgatgagtcacgccctgtcacggtcatactggatgaggataagccggatgtgacgattgacagtccggcaaacggtgataaaacaaataaagaagcagtgaccgtaaaaggaaaagtgcacgacgcccatttagaatgggtaaaggtgaacggaaaaaaagctgaagtaaataacggttcttatcaagcgagaacccttctggaaaacggcagcaatgagatcaaggtcacggcctcagatgaagcgggtaacaaaacaacgaaaaagacggtaatcgatgtcaattacaatgctcccgtcatttccggattggttcccggagcggataaggaattaaaagccggagaatcagtgaaaatcgctttttcaagcggaaagaaattagacgcttccttcgtgatccgtctgcctctgacaaacgcccgggcagggagccaaaacgcaacagagcttccgctgagagaaatttctccgggacgatatgagggttactggacggcgacttcttccatcaaagcaagcggagcaaaaattgacgttatcgcaagagatgactacggaaatgaaacgagacagacggctaaaggaaaactttatatcaatgagtaaaaacagagcgctgccaaatcacggcagcgcttttttagttgaaggggacaataggaaatcaaccctttcggccctcgacaaataaaacggttatcccttaaaaattgtactttaccctcaacattaattgacagactttcccacagagcttgctttatacttatgaaacaagagagagaaacagataagtaagacaaaagaggaaaggggtcagatgtgaaaatctatctggatgtcatttggctgttgaacttttgttttgattctcttttgcttttattgaccgcctttattttaaaacgccaggtgaaaaaaagaagagtggccgccggcggtttcatcgggtcagtcattgtgcttctgatgtttacgcctgtttctccctttgtggagcatccggcgggaaaaatggcgttttcagtagtcatcgtgcttacggcttttggctttaaacggttccgatacttttttcaaaatttgttcgccttttatttcgcgacttttctcgtcggcgggggaatgatcggcgtacattccctgctgcagacagaatcaattgtgcagcaaggcgtaatggtcacaagccagaccgggttcggcgacccgatcagctggatgtttgtagttatcggatttccggccatatggtttttttcgaaaaagagaattgaagacatcgagacgaagtccattcagtacgatgaacttgtcatggtgcaggcggaattcagcggacagacaatccgcgcgaaaggattggtggattccgggaatcagctgtatgatccgctgacgaaaacgccggtcatgatcctttgcattgacaaattcgctccgattctcagcgaaaaggaaacggacctcatcaaatccgccagtccgcttgaagtgatagagcagcttgatgattcgttccgccatgcggataagctgaggctgattccgtacaggggcgtcggccaggacaatcaatttttactctgtttaaagccggattacgtcacgattttaacaaaagacgaaatgatcgcttgtgaaaaatgcctgatcggcatcagcacgaaaccattatccgcggacggtgaatttgacggaatcgttcatccgaagatgctgacagggaaggctgtaaaacatgtttcctgacgaaaagtctgttattcatcatactcaaaatgcattgtatttagaagggggaggaagatgaaaaaacttaagctgcgtctgacatatttgtggtataaatggctgatgaaactcggactgaaaagcgatgaagtatattacataggaggaagcgaggcgctgccgccgcctttgtctaaagaagaggagcaggtgctcttattaaagctgccgagcggggatcaggcggcgcgggccatcctgattgagagaaacttacgtcttgtcgtttacattgcccgcaaattcgaaaacaccggcatcaatatcgaggacttaatcagcatcggcaccatcggtttgatcaaagcggtaaacacttttaatccggaaaagaaaatcaaactcgccacctacgcgtcgcgatgtatcgaaaacgaaattttaatgtacttgcgccgtaacaacaaaatccgttcagaggtatcatttgatgaaccgctgaacattgattgggacggaaacgaactgctgctttcggatgtgctcggcacagatgatgatattattacaaaagacattgaagccaatgtggataaaaaacttctgaaaaaagcgcttgagcaattaaacgaaagagaaaagcagattatggaactgcgtttcgggcttgtcggagaagaagaaaaaacacaaaaagatgtagccgacatgatggggatttcacaatcttatatctcccggctcgaaaagcggattatcaaaagactgagaaaagagtttaacaaaatggtgtaaaatttttccatctgacagcccttactgctgcaaggattgccgcagccggatgtttatttctgtaaaatggcggtgcatatttttcccacccgaggagatacttaacgttgtacagcagctcctagtgggagggaaaaacgtgtcaagaaataaagtcgaaatttgcggggtggatacctccaaattaccggtgctcaagaatgaagagatgagaaagctgtttaggcaattacaggatgagggcgatgattcagcgagggaaaagcttgtaaacggcaatctgcgccttgtcttaagcgtcattcagaggtttaacaacagaggagagtatgttgatgacttatttcaggtcggctgcatcggactaatgaaatccattgataattttgacctaagccataatgttaagttttcaacatacgctgtaccgatgatcatcggagaaatccgcagatatttgcgggataataatccgatccgcgtctcgaggtcgcttcgcgatatcgcatataaagcgcttcaagtaagagagcggttaatcagtgagacaagcagggagccgacagcagaggaaatcgccaaagttcttgaagtgccccatgaagaaattgtgtttgcccttgacgccatccaggatccggtttcactgtttgagccgatttataatgacggcggcgatccgatttacgtgatggaccagatcagcgatgagcgcaacaaggatacacaatggattgaggagctggctctgaaagaaggcatgagaagactgaacgaacgggaaaaaatgattttgcgaaagcgctttttccaagggaaaacccaaatggaagtcgctgaagaaatcggcatatcccaagctcaggtctcaaggcttgaaaaggcagccattaaacaaatgaataagaatatccatcaataacggaaaaagcctttaaaccttgtttaaaggcttttttcatgcgatggtttacgtttgcaaaaaagtgatgtattctaatgtgtaaaagtttttagaaaatttaaataaagtaaacgggggaaattgcagtgattttacagctggacagtgtgtcattaaaaagaaacgggaaatggattttgaaagatattaactggcgcgtcgagaaaaacgaaaattgggtgctgtacggattaaacggagccggaaaaacggctttgctgaatatgttatgctcttattacttccccacttcaggagagatgcaggtgctcggccatcaattcggcaaaacagagctcggtgacaggctcagaaggaaaatcggccttgtttcggcaggtcttcagcacaaattatatgccgcggactccgcttttgaaatcgccctcagcggcgcgtacgcctcaatcgggctgtacgaaactccgagtgagcaagtaagggaaaaagcgatcggtcttctgaaggatttgggcgccatcggttacgccgacagacggtatgaaacattatcacaaggggaaagacaaagagcgctgattgcgcgggcgcttatggctgatccggaactgctgattttggacgaacccgtgacgggtcttgattttatggcaagggagcagctgctggacacgattacgtcgatcgccgaaaaagaaaatgcgccgtccatcctttatgtcacccatcacgctgaagaaattctgccggtatttgatcaggcgcttcttttaaaacagggcgaggtgttcgcctccgggaaaatcagggacatgctttctgacgagcggcttacagcgtttttcgatatgcctgtcaatgtcttatggaacaatggccgcccgtttttaacacgtgcaaaagaggcatcatccgtaaaataacataaattcaccctgggggtgctgccacgcggctgagagaggcgttgtctcaacccttaacggacctgatccggatcatgccggcggagggaagcggtgaaaaaagcggaggaagatccgttttttacccgtttcatttcatgaatgaacgggttttttgatacagccaaaggggagatttccaatgcatcagattgatatgctgttacaccaggcggagaaacggcggcacgacttcatacatattgctgaaagactgatagcctttcccactccggccccgccagcaagaaatacggcagaagcccaaaagtgggtggccggctttttaaaagaaacgggctgctcggtcgatatgtgggatgtgtatccggaagacccgaatgtagtcggtgttttagaagggacagattcaagcaggcatcaaagcctgattttaaacggacacattgatgtggcagaagccgggggcgaagactggcactctgacccgtttcagccgctcgtaaaagacggcatgctgatcggaaggggcgccgctgatatgaaaggaggattggcgtgtgttcttttctctctgaagctgatccatgatgccggcattaagcttccgggcgacctcattgtacagtctgtaatcggagaagaagtcggtgaggcggggacgctggaatgctgcaaacgcggctatcacgcggattttgcggttgtcgcggatacgagcagcctgcatattcaagggcagggcggtgtcatcaccggctggatagaattgaaaagcaaacaaacatttcatgacggcatgaggcgcaatatgattcatgcgggcggaggcacattcggagcgagcgccatcgaaaaaatggcgaaaatcatcgctgccttgggagagctggagcgccactgggcggtaacgaaaagctatcccggctttgcgcccggcaccaatacgatcaaccccgccgtcattgaaggcggaagacacgcagcgtttgtcgccgatgaatgccggttatggatcaccgtccacttttatccgaacgaaacgcacgaacaagcagccgcagaaatcgaagactatattaatcgtgtcgctgacagtgatctgtggctcaaagaaaacaggccggtgttcaaatggggcggatcttcgatgattgaagacagaggagaggtgttcccggcgctgaaaatcgacccggaccatccggcagtttctgtcttggctgcatcacactcagccgtcaaaaaacaggagcccgtcattgatgtttcccaaaccgtaacagacggagggtggctttatcatgccgggattccgagcgtcatatacggccccggcgatttaaaaaacgcccactccgtaaacgaggaagtgtccgttgatgagcttatggactatacgaaaatcatgctgagatttatcctcggctggtgcagccgcaaaaaagattgcccgatgtgacaaggttcagcccggccgttcatataataggaaaaagaacgggcaaagggcgtgatacggatgatcagcatatctgaatttcaaataaaagatgtggtaaacgtgtcgaacggaaaaaaactcggaagcatcggtgatattgatattaacgtgacaacgggaaaaattcaggcgattattttaggcggaagcggaaaagttctcggttttttcggaaaagaagaggaaatgatcattccttggcgaaatatagttaaaattggggaagatgtcatcttagtgcgtgtaaatgaaccaaaggggggagcgtaatcctcccttcacttgtaaaaagccggaaatctcaatgtttccggcacatttatttatctcatttttcaatcagccgctaaacgtatgcttaaaattgtgttaaaatgagtgggaaattacgcttttttaatgtttgtcgaaaggttggatctccatgaatacatatcacccgtttagtcttaccaccccctcggcactcatgatagaagactggaactgtgtgaatcagcttaacacaaaggtcatcgccggattcacgacgaaaaacggcggggtcagcaatcctccgtatgagtcattaaataccggattgcacgtccgggacgaagctcatgatgttgtgacaaaccgtgaagtcatagcgtccttatgcggtactgatctggattcctgggtgttcgccgaccagacacatgaaaaccgcgtccggcgcgtgacagccggggataaaggaaaaggagcaagagactattcttccgcattccgcgggacggacgggctctacacgaaagatgcgaatctttttttggccctttgttttgcggactgtgtgcccttgtatttttatgacccggtgaaatccattatcggcgctgcccatgccggatggaaggggacggtcaaacaaatcggacgcatcatgacggaacgctgggtaaacgaagaaggctcccgtttaacagatattcaggctgtcatcggtccgtccatcagcgcgggaagctatacagtcgacgaccgcgtcatcaatgaagtgcgggcgctgccttttacggctgaatccgccatatgcgaaacggaaaaaggccagtatcagcttgatttaaaagaggtcaaccgtcttcttctgatacattgcggcattccggaagaaaacatttcagtcagcggtttatgcactgaacgagagcgtgaactattcttttcacaccgccgcgacaaagggaaaacgggacgcatgatgtcctttatcggaatgaaggaggcgtaagatcttgcgtgttgctgatcaattacgacatataaacgaaagaataaacgaagcatgtaacagatcgggccgaagccccgaagatgttaccgtcatcgcggttacaaaatacgtatcagccgaaagggctcaagaggccgttgatgctggtattacaagtctgggagaaaaccgggatgccgagcttatccataagcaggaagtcatcaaaggcagcccggagtggcactttatcggcagtcttcagtccagaaaggtgaaggccgtcgttgaccgtgtgtcttatattcattccttagacagactgtcattggcaaaagagattgaaaaacgggcgcagcatacggttcgctgttttgtgcaggtgaatacttcgcttgagccgtctaagcacggtttgaaaacagaggaggtcatcccctttatcagagagctttctgaatttagaaacatttctgtagagggcctgatgacgatggctcccctgacagacgatacagaaacgatcagagactgcttccggcaattgcgtgatatgaggtatcaggtgcaaaaactgaatcagacaaacgcaccgtgccgggaactgtcaatgggcatgtcaaatgactatgaaatcgctgttgaagagggcgcaacttttatcagaatcggctcttcattagtcggaaatgaaccggggggtgtaaacaaatgagcatgaaaaataaactgaaaaactttttctcaatggatgaggaggagtacgaatacgaatacattgaaacggagcaggatcatccggaagagcatgaacagcagaaagataaacagcctgcttacgctcagaagccgcagggcaagcagaacgtagtaagcttgcaaagtgttcagaaatcctctaaagtggtgttgagtgaaccgcgtgtatatgcggaagcgcaggaaatcgccgatcatttaaagaacaggcgggcggtagtcgtcaatctgcagcgcatccagcatgatcaggcgaaaagaatcgtcgactttttaagcggtaccgtctacgccatcggcggcgacattcagagaatcggttcagatatttttctgtgcacgcctgataatgtcgacgtttccggcacgatttcggagcttataaatgaagacgaacatcagaggtggtaaagcaggatgattctttatcaaattttttccgttctgagttatttaatttacatctactcgtttgccctgatcatctatatctttatgtcatgggtgccgagtacgagagaaacggcggtcggacggtttctcgcagcgatttgcgaaccgtatttagagccgttcagaaggatcattccgcccattgccatgttggatatatccccgattgtagcgattatcgtgcttcggtttgccacgacgggactttggggcctataccgcatgatcgcaatgtatacttgaatgcgacagtttgatacgggcttggcaccagccaagcctctttacatagaaaggaaagaacatgagcgatatttaccagcacttcagacaagacgagcggccttttattgatcaggcgcttgaatggaaacagattgtcctggaccagtatcggatgaagctgactgatttcttagatcccagagaacaggtgattgtaaaagccgttatcggcgacgcctgcggtcttgcgtttttcggaggatatgacagagctgagcgcaaacgcgcgattttataccctgaatatatggaacctgaacaggatgattttgagcttcgggcttttgacgttcaatacgctgaaaaattcgtcagcattgaccaccgctctcttctcggatcattaatggggatcggcttaaagcggcagaaatacggcgatctgattttctcagaggaagccgtgcagctgatcgtctccggtgaaatcgccgattttgtcagcactcagctgaccaaagcgggcaaagcgccggtaaagcttgagaaaatcgagctttccgctcttcacattcccgcttcagatgtcgaaataagggatgacacggtttcttcattgcgtctcgacgccgtctgcgcttcaatgagcaggcaatcccgtcagaaagcgcaggcgcttgtgaaaaacggcctcgttaaggtgaattggaaagccattgaagatccgtcttttcaggttgctgaaggggacatgctctcgattcgcggcttcggacgatgcagtttggcaaaagttgacggaaaaacgaaaaaagacaaatggaaagttacatttgaacggcaaaaatgagtcgttttttcagtttttttctccatctgtgccgtatttgttttataatgtgaactagataaccgtactgaaatgtaaaaatggaggtggcaatatgccattaacgccgaatgatatccataacaaaacgtttacaaaaggttttcgcggatatgatgaagatgaagtaaatgaatttttaatgcaggtcagaaaagattacgaaatcgcactccgtaaaaaaacggagcttgaggcgaaagtgaacgagctggacgaaaaaatcggccactttgccaatatcgaagaaacgctgaataaatcaattctcgtagcccaggaagccgcagaagacgtaaagcgcaactcgcagaaagaagcgaagctgatcgtccgtgaagcagaaaaaaatgctgatcgcatcatcaatgagtcgctttccaaatcaagaaaaatcgcaatggaaatcgaagagctgaaaaaacagtctaaagtcttcagaacacgtttccaaatgctgattgaagcgcagctcgatctgctgaagaacgatgattgggatcatctgctggaatacgaagtcgacgcggtatttgaggaaaaagaataattttctgattttcttgacattctccggcccgttcgaatataatacgttcataaattcagatgaaaagacgattgaaagggaccggcatgactcaaaacaggctataaagcgacccggggaaggtgaaagcccgggatggccggaatcatgcagatcagccctttagtttcctttctgaaccgagagtaggaaaggacgttccatcacgttacgatgttcgagaggaaaagacggatgatccgttttttctaaaagggtggtaccgcgagataagctttctcgtcccttatgggatgagagggctttttttattttctgaaaaatgttgtggaggaatgaaaatggattacaaagatacgctgttaatgccgaaaacagattttccgatgcgcggaaatctgccaaatcgtgagccggacatgcaaaaagactgggaggagcaggacatttaccgtcttgttcaagaacggacgaaagaccgcccgaaattcgtgctgcatgacggacctccttatgcaaacggagacatccacatgggccatgccctgaacaaaatcctgaaagacttcatcgtccgctataaatcaatgagcggctacaacgcaccgtacgtgccgggctgggatacgcacggactgccgattgaaacggcgctgacgaaaaacaaaaaggtcaaccgcaaagaaatgtcagtagcggaattccgcaaactatgcgaagagtacgcttggaagcaaatcgagggacagcgtgagcaattcaaacgtcttggtgtccgcggtgactgggaaaacccatacgtgacattaaaaccggaatacgaagcgcagcagatccgcgtatttggtgaaatggcaaaacgaggctacatttacaaaggccttaaaccggttaactggtcaccttcaagtgagtctgctctggctgaagccgagatcgaatatcaagacaaacgttcagcatctatttacgtcgcttttggtgtaaaagacggaaaaggcgttcttgaaaacggcgagcgcatcatcatttggacaacaacgccttggacaattccggcgaacctcggaatctcagtgcaccctgatcttgagtacagcgtgattgcagtaggtgaagaccgctttgtcgtagcaagtgccttagtcgaaaatgttgcatcagcatgcggatttgatcagtatgaagtgacaagaacggtcaaaggaaaagaccttgagaacattatcgctgaacacccgctatatggcagagactctctcgttatgcttggtgaacacgtaacaactgatgccggaacaggctgtgttcatacagcgccaggacatggggaagatgactttatcattggccaaaaatacggtttagatgtgctttgcccggtcgatgaaaaaggtgtaatgactagcgaagctcctgggtttgaaggcatgttctatgatgatgcaaacaaagcgatcacacagcagctcgatgaaaaaggcgcacttgtgaagcttgaattcattactcactcttatccgcatgattggagaaccaaaaaaccaaccattttcagagcgacagcgcaatggtttgcgtctattaaagatttcagatcagacctgctggatgccattaaagaaaccaaatgggttcctgaatggggtgagcagcgtttgcacaacatggttcgggaccgcggagactggtgtatttccagacagcgtgcgtggggtgtgccgattccggtattttacgctgaaaacggagaaccgattattacagatgaaaccattgaacatgtttctgaattgttcagacagcacggatcaaacatttggtttgaaaaagaagcaaaggatcttcttccggaaggctttacgcatcctggcagcccgaacggcacatttacaaaagaacaggatatcatggatgtttggtttgattcaggctcttcacatcaagcagtgcttgaagaacgtgatgacctcgttcgcccggctgatttatacctagagggatctgaccaatatcgcggctggtttaactcttctctttctacagcagtagccgtaacaggaaaagcgccgtataaaggtgtgctcagccatgggttcgcactggatggagaaggacgcaagatgagtaaatcaatcggtaacgttgttgttccggctaaagtcatgaaacagcttggtgccgacatcttaagattatgggtatcgtcagtggattatcaggcggacgttcgcgtgtctgacgccattctgaagcaggtcgcggaagtataccggaaagtccgcaacacgttccgcttccttcacggcaacctgttcgatttcaatccaagcgtcaatgccgttgatgtaaaagatctccgcgaagtggatcaatatatgctgatcaagctgaataagctgattgataaggtgaaaaaagcgtacgatgaatatgaatttgcggttgtttatcacagcattcacaatttctgtacgatcgagctcagctccttctatcttgattttgcaaaagatgttgtgtacatcgagcatgcggatcatccggaccgccgcagcatgcagaccgtcttttatgaaacgctgctggctttagtgaagctgacggcgccgattctcccgcatacggcggatgaaatgtggtctcacttatcatttgttgaagaagcaagcgtgcagctgacagatatgccggaaaccattgctgttccggacagtcaagcgacagaagaaaagttcgaccgcttcatggagcttcgaaacgacgtgctgaaagctttggaaacagcccgtaacgaaaaaattatcggaagatcattggaagcgagcctgactttgtatccgaacaaagaaaaccgcgacctcttgtcatccattaaagaaaacatcgcgcagctgtttatcgtctcagaactgacagtaaaagacgaaagtgaagcgcctgaaaacgcgcaaagtttcacaacaggaaaaatgaccgtagaaaaagcggaaggccagatgtgtgaacgttcccgcgtcatttctaaagatgtcggagccaatccgaaatatccgacattatcactgcgcaatgcggaaatcgttgaaaaatattatcaaaaataataaatgggaaagcgcccggtgtcagccgggcgcttttttacatgccagcaatgtcatcgattagaacgacaggaaaaatcttatgggcttcaaatggcgctctgggggcaacaataaagccataacatcaagagcaggagttgtgatgaatgaatgatcaactgaccgcaatccacacggagcttctcatgatgaaagaagaacttcaatcaagattattcgaatattcttgctttcaaatgtcagcatctgttgaaccttcaatgaacgaccaagaagcaactctgatctatcatataaaagaagaacttcaggacgttcttcttgccctgtctaagtttgaaaacaatacgtacggttattgtgaaaaaacaggcgcccccattccgattgaaaaacttgcggtgttgccgacggccagaaccgctgatgatttttattatcccgctcaatttgaaaagaaaacccttccatattgggaacccggagattatgcatatgatcaggcgctgtatgagtgacagcgtctgtttgcatgcgcttatgatctgcctttactctggcatcttttactgataaaattcataaaggataaaagtaactgtatactggaggaacgtgtgtgctttattatcttatcgctctttttattattattgccgaccaattgaccaaatggcttgtcgtcagccatatggaattgggacaaagcatacctgtcatcaatcaggtgctttatatcacatctcatcgcaacacgggagcggcgtgggggattttagccggccaaatgtggtttttctacgtcattaccatcgccgtgattatcggaatcgtttattacatacagcgttatgcaaaagggcagatgttactcggaatttctctcggcttaatgctgggcggtgcggccggaaactttattgaccgggcggcgcgccaggaagtggtggattttattcatgtcatcatcgtggattatcactatccgatttttaatatcgcggactcctcactgtgcgtcggtgtaatacttttatttattcatatgctgtttgacagcgggaaaaagaaggagcaataacatgaatcaatttgagataaccgttcagcctgaacaaaagagcgaacggattgataaatttttggcttcaacgggagaaaactggtcacgcactcaagtgcagcagtgggtaaaagagggactggtatccgttaacggcaaatccgtaaaagcgaattataaaatgcagcccggcgatcaggtaaacgtcaccattcctgaaccggaagaattggacgtgcttgcagagccgatggatttggacatttactatgaggatcaggacgttttggttgtgaacaaaccgcggggcatggttgtacacccggcgcccggccatgtgacagggacgcttgtaaacggactgatggctcactgcaacgacctttccggcattaacggcgtcatgcgtccgggaatcgtccaccggattgataaagatacttccggtctgttaatggtcgctaaaaacgatatggcgcatgaatcactcgttaatcagctcgtcaataaaaccgtgaccagaaagtacacagcggttgtccacgggatgatttcacatgatgacggaacgattgacgctccgatcgggagagataaaaaagaccgtcaaagcatgaccgtaacaagagaaagcagcaaaaacgccgtcacgcatttccacgtgcttgagcgttttcaagatttcacgctcgtagagtgccgtcttgagaccggaagaacgcatcagatccgtgttcatatgaaatatatcgggtttcctttggcgggcgatccgaaatacggaccgagaaaaaccgttgattttaacggtcaggcgcttcatgccggaatattaggttttgaccatccgcggacgggcgaatacattgagtttgaagcgccccttcctgaagatatgaaaaaactcattgaagatttaagaaatagccgttgacagcgagtttcttttctgaaataataaaaacaagctgaatagattctttaacacagtccagagaggctgagaaggataacggataggacagaagagatacgcatgtgtcttcgtcctggaaaggaacccctctatgctctggcaggaggggttttttcttcttatatacgaatggagaggtgtcacgagtgaatcaaaaagctgttattctcgacgaacaggcgatcaggcgggcgctgacaaggatagcccatgaaatgatcgaacggaataaaggaatgaatgactgcattcttgtaggaattaaaacaagaggcatttatttagcgaagcggctggccgagcggatcgaacagattgaagggaatccggtcaccgtcggggaaatcgatatcaccctttaccgtgacgatctcacgaaaaaaacgagcaatgaagagccgcttgtaaaaggcgcggacattccggccgatatcacagaccaaaaggtcattgtggttgatgatgtgctttataccggccggacggtgagagctgcgatggatgccctcgttgatgtcgggcggccgtcatcgatacagcttgccgtgcttgtcgacagagggcaccgggaactgccgatcagagcggactatatcgggaaaaacattccgacctcaaaagctgaaaaagtgatggttcagctgagcgaagttgatcagactgatatggtcgccatttatgaaaatgaataaccaccctttttaaatgcattccagagagtttgcaaagaggattttaaaacacaaagccgggcggatcgacgcggccgggttttgtatgcctctttgcgcaaaaagcaaagaggtttttttataccatttgaaagtcaaccgggaggaaaacgccatgagtaagaaaaaagtaaacctgggagtcagggacgtccccaatccattgtcctggctgtcattcagcctgcagcatttattcgccatgttcggctcaaccatactcgtgccgaaactggtcggaatgagcccggctgtggcgcttgtcacaagcggaatcgggacactcgcctatctcttggtgacaaaaggccagattcccgcttatctcggctcatcattcgcctttatatcaccgattatcttagtgaaggcgacgggagggccgggggctgccatggtcggcgctttcctggcgggaattgtgtacggcctgatcgcacttctcatcaggcagcttggaacggggtggctgatgaagctgctgcccccggtggtcgtcgggccggtcatcatcgtcatcggcctcggactggcaagcacagccgtcaatatggcaatgtatgctgatccgaatgcgaaggaactcgtctacagcttgaaacatttcagtgtagccggcgtcactttggcaatcaccattatctgcgccatctttttacgaggatttttaagcctgattccggtattgatcggcattataggcggatatctgtttgcgctgacacagggcatcgtcaattttcagccggtcattgatgcaaaatggttcgccgctcctgaatttatcatccctttcaaagactatacgccgtcagtgacattgggcattgcggctgcgatggtgccggtcgctttcgtgacgatgtcagaacatatcggccaccaaatggtgctgagtaaagtcgtcggacaggatttcattaaaaagccgggactgcaccgctccataatgggggacagcgtagcgacgattatcgcttcgttaatcggcggcccgccgacgacaacatacggcgaaaacatcggtgtactggcaattacgagagttttcagcgtttttgtcatcggcggcgcgggtgtgattgcgctgtgcttcggatttatcggaaaagtttcagcgctgatcagttctgttccgtccgcggttatgggaggcgtttccttcctgctcttcggaattatcgcctccagcggcttaagaatgctgattgacaacaacattgattatgaaaacaagagaaatttaattatcacgtccgtcatcctcgtgatcggcgtcggaggggcttttattcaagtatcaaaaggtgggttccaaatatccggcatggcgcttgcggcaattgtcggagtcatcctgaaccttatcctgccgcatgcaaatgaagaagacgcgattgcatcagaaaaacaaaatcatatgtaaaccttttaaagaaagtccagagaggcttggaagggttataacgggaagaagctgtacgccgcttctctctttaaccgcaccccgagtctatagaccggggtgtttttttacggccttcaagcggaaacggaggagaaaaatatgaatcatttaacggcaatgtctgaactgagcactgctgaaattacagaactgctgcgtgaggcaaaagcgataaaagagggaacagtccgccccgatctcgcggggaaattcgttgcgaatctgttttttgaaccgagcacgagaacgcggttcagctttgaagtggcggaaaagaaactcggaatgaacgtgctcagcttagacgatacgagcacaagcgttcaaaaaggcgagtccttatatgacacggtcaaaacactggaatcaatcggagcggacgcctgcgtcatccggcacagcacggatgaatattacaaagatctgaccggcagagtcaatattccgatcttaaacgccggcgacggctgcggccagcacccgactcagtcattgctcgatttaatgacgattcaagaggaatttgagacctttcagggcctgacggtttccattcatggcgatatcaaacacagcagggtggcaaggtcgaatgccgaggtgctgacaaggctcggcgcacgcgtgctgttttctggtccgccgcaatggcaggatgagaaaaacgccttcggcacctgtgttcagacggatgaagccatacaagcttcagatgtcgtcatgctgctccgcatccaaaatgaaaggcatcagacagaagccgaccaaaaaggctatctggaagcatacgggctgaccgcaaagcgggcggagagcatgaagcggcatgccatcatcatgcatcccgcaccggtgaacagaggagtcgaaattgacacaacattagtggaatgcggaaaatcaagaatctttaaacaaatggaaaatggtgtgtatatcagaatggcagtcttaaaaagagcactgcaaaccaatgtgaaaaggggagaagcggcttatgtcttatctcattaaaaacggctggatgttaaatgaacagggagaaaaagtggcacaggatatccgggtaacgggtgaattcattacggaaaccgggcttctgacagtgaaagaaggagaaacggtgatcgacgctgacggactgtttgtttcaccgggactcgtagaccttcatgtccacttcagagaaccgggcggcgagaaaaaagaaaccattgagacgggctctaaagccgcggcgcggggcggctttaccacagtcgcagccatgccgaatacaagaccggtgccggatacgaaagagcagatggaatggctgcaaaaccggatcaaagaaacctcatctgtcagggtccttccttacgcatcaattacgatcagacaaatcggcgaagaaatgacagattttgaggcgcttcatgaagcgggcgcattcgccttcaccgatgacggcgtcggcgttcagacggcaggaatgatgtatgaagccatgaaacgggcggcttcaatgaataaagcgattgtcgctcattgtgaggataactcgcttatttacggcggaagcgtgcatgaaggatctttttcaaaagcgaacggcctgaacggcataccttccatttgtgaagcggtacatatcgcccgtgacgtcctgctggcggaagcggcgggctgccattaccatgtgtgtcatatcagcacgaaagaatccgtcagagccgtaagagacgcaaaaaaagcgggaatccgcgtgacggcggaagtgtcgccgcaccacctgctgctttgtgacgaagatatcccgggacttgataccaattttaaaatgaatccgccccttcgcagcaaagaggacagagaggcgctgattgaagggcttttagacggcacgattgatttcatcgccactgaccatgcgccgcatacagaagaagagaaaaacacggatatgaagcttgcgcctttcggtatcgtcggtttagaaacagcctttccgcttctgtacacacattttgtgaaaaacgggacgtggacgctgaagcagctggttgatttcatgacggtaaaaccttgcgaggcattcggtcttccgtacggaacgcttgcaccgggggcgccggctgacattaccctgattgatctggaaaaagaagcggccattgacaaagatacatttttatctaaaggaaaaaatacgccattcaacaagatgaagtgcttcggctggcctgttgcaacgatggctgccggtaagcttgcatatgaagaagggagactcgtcaaatgaaaagaagactagtgctggaaaatggagcggtatttgagggtgaagcattcgggagcctggaacataccgcgggtgaagttgtattcaacacgggaatgaccggttatcaggaaattttatcagacccttcttactgcgggcagatcgtgacgctgacgtatcctctgatcggcaactacggaattaacagagatgactttgaatccatcactccttttgtaaaagggctgatcgtaaaagaactgtgcgagctgccttccaactggcgttcggcttacacgcttgacgagtatttgaaaatgaaaaatatccccggcttacaagggattgacacgagaaagctcacaagaatgatccgcacggccggcgcattaaaaggaacgtttgcttcaagcgaggagaatgtcggtgaggttcttgcaaggctgaaagaaacggaactgccgagaaatcaagtcgctcaagtatctgcgaaaacggcatatccgagtccgggccgcggcaaacgcatcgtactcgtcgatttcggtatgaagcacggcattttaagagagttaaacaaaagaaaatgcgatgtcatcgttgtgccgtacaatgtaacggcggaagaagtgcttcagctcaagccggacggcatcatgctttctaacggacccggagatccgaaagatgtgccggaagccattgaaatgataaaaggcatactcgggaaggtgccgttattcggaatctgcctcggccaccaattatttgcgctggcatccggagcggaaacggaaaaaatgaaattcggacacaggggttccaatcatccggttaaagagcttgcgacagggaaagtcgctttaaccgcccaaaaccacggatatacagtttcttcaatagatgagacagagcttgaagtgacgcacattgcgatcaatgatcaaacgatcgaaggactcaagcataaaacgttgccggcatttacggttcagtaccaccctgaagcttcaccggggccggaagacgccaatcatttatttgacagattcattgacttgatcgaaacaactgagaaagaaggggaagcggtatgccaaaacgcgtagatattaaaaagattttagtgatcggatcaggcccgattattatcggacaggcggcggaatttgattatgcgggcacacaggcgtgtctcgctttaaaggaagaaggctatgaagtcattctcgtcaactcgaatccggcaacgattatgacggatacggaaatggctgatcgggtatacatagagccgctgacgccggagtttctcacgcgtattatcagaaaagaacggccggacgccatcctgccgactctgggaggacagaccggactgaaccttgccgtcgagctgtctgaactcggggttcttgaggaatgcggggtggaagtgctcggcacaaagctgtccgccatccagcaggcggaagaccgcgacttattccgtacgctgatgaatgagctgaatgaaccggtgccggaaagtgagatcatccgcactttacaggaagccgaggaatttgtcggccggatcgggtttccggttatcgtgcgccccgcttacacattaggcggaacgggcggcggcatctgctcgaatgaagcggaactgaaagagatcgtcgaaaacggattaaaactcagccccgtccatcagtgccttctggaaaaaagcattgccggttacaaagagatcgaatatgaagtcatgagagacagcagagatcacgcgatcgtcgtctgcaacatggaaaatatcgatccggtcggcatccatacgggcgacagcatcgtcgttgccccgagccagactttgagcgaccgggaataccagcttttgcgcaatgtttcattaaagctgatccgcgcgctcggcattgaaggcggctgtaatgttcagctcgcgctcgatcccgacagcttccaatattacattatcgaagtgaatccgcgggtgagccgctcatctgccctcgcctcaaaagcgacgggttacccgatcgcaaagcttgcggcgaaaatcgcagtcgggctttctcttgatgaaatgatgaatcccgtaacgggaaaaacatatgcggcttttgagcccgcgcttgactatgtcgtttctaaaatcccgcgctggccgttcgacaaatttgagtcggcaaaccgcaggctcgggacgcaaatgaaagccaccggagaggtcatggccatcggacgcacccttgaagaatcgctgttaaaggcggtccgctcactggaagccgatgtctatcacctggaactgaaggatgcggaagagatttctgacggacttttggaaaaacggatcagaaaagccggggatgaacgcctgttttatcttgctgaagcgttcagaagaggctatacagtggagcagcttcatgagttttccgcaattgacgtattctttttgcacaagctctggaagctggtcgcttttgaaacagagctgaaagcggaaaaaggcagcctcgccgtccttcagacagcgaaggaactcggtttctccgacaaatatatcagccgggaatggaatatgccggaacaagagctgtatcaaatgcgaaaagaagcagacatcaagcctgtatataaaatggtggatacatgcgcggcggaattcgaatcagaaaccccgtacttctacagcacatatgaggaagagaacgagtctgaggttacttcaagaaaaagcgtcgtcgtcctcggttccgggccgatccgtatcggacagggcgtcgaatttgactatgcgaccgttcattctgtctgggcgatcaagcaggcaggctatgaagcgattattatcaacaacaatcctgagacggtgtccactgatttcagtatatcagacaaactgtattttgaaccgctaacggttgaagatgtcatgcacatcatcgatttggaacagccggaaggcgttgttgtccaattcggcggccagacggcgatcaatcttgcggaagaattgagcgcccgcggcgtcaaaattctcggcacatcactagaagatttagaccgtgcggaagaccgggataagttcgagcaggcgcttgaggcgctgaatgtgccgcagccgctcggaaaaaccgccgtgtcggtgaacgaagcggtcaaaatcgccgcatccatcggctatccggtacttgtccgcccttcgtatgtgctcggcggccgggcgatggaaatcgtctatcacgaagaagagctgcttcactatatgaaaaatgcggtcaaaatcaacccgcagcatccggtgttaatcgaccgttatctgacggggaaagaaatcgaagtcgatgccgtatctgacggcgaaacagtcgttattccgggaattatggagcatatcgagcgggccggcgtccattcaggggattcaatcgccgtctatccgcctcagtctttaagcgaagacataaagaaaaaaatcgaacaatacactgtagccttggcaaaaggccttaacatcatcgggttgctgaacatccagttcgtactgtcgaaaggcgaggtgtatgtgcttgaggtaaatccgcggtcaagcagaaccgtgccgttcttaagcaaaatcacaaaaatcccaatggcgaacctggcgacaaaggtcattctcggccaaaagcttgctgatttcggctatcaagaggggctgcagcctgaacaacagggggtattcgtgaaagcgcctgtcttctcattcgcgaagctgagaagagtggatattacgttaggccctgaaatgaagtcgacgggagaggtcatgggcaaagattcaacccttgaaaaagcgctctataaagcgctgattgcctctggtattcaaattccgaactacggctcagtgctgttgaccgttgccgataaagataaagaagaaggattgctgatcgccaagcggttccacgccatcggctataaaatcttagcaacggaaggaacggcggcttatttgaaagacgctcagattccggctcaggtcgtcggaaaaatcggtgaagaagggaaaaatctgctcgatgtcatcagaaacggcgaagcgcaatttgtcatcaatacgctgacaaagggcaaacagccggccagagacggcttcagaatccgccgcgaatccgttgagaacggagtcgcctgcctgacatctttagatacggccgaagccattttgcgggtattggaaagcatgacattccgggcggatcatatgcctgcatccgaaaccaatcaaaaggcggcagtcacgatatgaaaaaagcgcatttgactgttcaatccaacttagagattgccgacaggatttataagatggtgctgaaaggagagcttgtccggcaccttaccgagccgggtcaatttcttcatctgaaggtgagtgacgcggtcacgccgctattaagaagaccgctcagcattgcggacgtcaatttcgccgcgaatgaagtatccgttatctacagagctgacggtgagggaacgcgtcttttgtccgagaaaaaagagggcggcaggatagacgttctcggccctctcggcaacggattccccgtccggcggattgaacccggcaaaaccgcgctgttagtcggaggcggagtcggggttccgcctttgcaggaactatcaaagcgcctgacggaaaaaggcgtaaacgtcattcatgtgcttggatttcaatcagcaaaggatgttttttacgaacaggaatgtcgtgcgtacggagacacctatgtggcgacggctgacggaacatatggagagaaaggatttgtcaccgatatcatccgtgaaaagcagctcgaattcgatgtcctgctaagctgcggaccgacaccgatgctgaaagctctgaagcagcagtacggccataaagaggtttacctttcgatggaagagcggatgggctgcggcatcggggcctgcttcgcctgcgtgtgccgcacgggtgaaagcgatacatcctatgtaaaggtctgccttgacgggccggtatttaaagctgaggaggtggcgctgtaatgttagaagtgaatctgccgggtctccaattgaaaaatccgatcatccccgcttccggatgtttcggtttcgggaaagaatatgccggattttacgatttatcatgtctcggaggcattatgattaaagcaacgacgaacgaagcccgcttcggaaatcctacgccgagagtggcggagacaagcgcgggaatgctgaatgccatcggactgcaaaatcccgggcttgagcatgtgctcaatcatgagctgccttggctcgaacaatttgacacgccgattatcgcaaatgtcgccggttctcaggtggacgactataaagaagtggccgagcacatcagccaagcgccgaatgtgcatgcgcttgagcttaacatttcatgtccgaatgtcaaaacgggggggattgcttttggcactgatcccgtcatggcggccgaactgacaaaagcggtgaaagaagtttccgcagtgcctgtgtatgtgaagctttcgcctaatgtcgcaaacataaccgaaattgccaaagcgattgaagcggccggtgctgacggtctgacgatgattaatacactcatcgggatgaggctcgatctcaagacgggacggccgatcttagcaaataaaacgggcggactgtcaggcccggcgatcaaaccggtcgccatccggatggtatacgaagtcagccaggccgttcaaatcccgattatcgggatgggcggcgttcagaccgcagaggatgcattagaatttcttcttgcgggagcgagtgcggttgccgtcggcacggcgaacttcgtcaatccgttcgtctgcccggaaatcatagaacagctcccccgtgtgctgcgccaacacggctttcaatctgtaagtgaatgcatcggaaggagctggaaacatgaaaaacaacctgcccatcatcgcgcttgattttgcatcaagggaagagactttaacgtttttagacttgtttgaaaaggaaaggctttttgtcaaaacggggatggaacttttttatcaggaaggccccgccatcattcaccaattaaaagaacggaactgtgatatatttttagatttaaagcttcatgatatcccgactacggtcaataaagcgatgaggcggcttgccggcctcggcgttgatctcgtcaatgtgcatgcggcagggggcgcacgcatgatgcgcgcggccctagaggggcttgaagaaggcacgccggcaggcagaaaacgaccgtctttaatcgcggtgactcagctgaccagcacttcagagcaggtggcgaaggaagagcttctgctgcataagccgctgttagaaacggttgtgcattacggcaaaatggcggaagagtgcgggctggacggagtggtatgttcggtacatgaaacaaaagccatttatgaagcggtccggccttcatttctgacagtcacaccgggcatccgcacggccagtgacgcagctgacgatcaagtccggacggcgactccgttatttgcgaaagaaaacgggtcgtcagccatcgtcgtgggccgctcaattacaaaagcggaaaaccccgttaaagcatatgaagcaattaaactggaatgggagggcgttcgccgatgaaacaggctatcgcaaaacatctattacacattgaagctgtctttttacgcccgaatgagccgtttacgtgggcgagcggcattttatcaccgatctattgtgacaaccgtctgacattgtcgtatccaaaagtgagaaatgatgtggcggacgggctcggaaaactgctgaaagagcatttccccgaggcggagatgatcgcgggcactgcaacggcgggcattccgcatgctgcgcttctcgcagatcgtacaggcgcgccgatgtgctacgtcagaagcaaaccgaaagcgcacggcaaaggaaatcaaatagaaggcgccattaagaaaggacaaaaaacagtcgtgattgaagacttgatttctaccgggggcagcgtgcttgaagctgcggcggcccttcaaagagagggcgcggaagttctcggcgtcatttccatttttacatacggactgccgaaagcaaaagaagcctttaaaaaagcgggtcttccttattactcgttaacggattatgacacgctgattgaagtcgcgcttgaaaacggaacgattcattcagctgacattgaaaaactgaaatcatggaaattaaatcccgagtcaaaagattggtttaaaaaataatgacaataaaaacaggcctcagggcctgttttattattcctatcaaaaaactcgggttgacttctgttagaattgtgctaaaatttagtacaaatctaaaaagcttatcaagagcggctgagggactggaccgatgacgcccggcaacctgcgtgaattgcaaggtgccgcatccagaaaaatgcacagcattttgaagataagggctataccgggtcactgtctttcattccgctggattgaaagttttttatatgaaaaaaagattgagggataagacaaccggcagaaaacaacagctgtttgattgtctccgggaggaggaaagaaaaaatgctaacgtatgacacatgggaagagccggcgattacatttccggaagacgattcctataaaggcgcgctgtccgttttaaaatgggcatacggccactacggagaccagcttgtttacgcgtgcagcttcgggattgaaggcatcgtcctgatcgatttaatttctaaagtaaagaaagacgcggaaatcgtgtttcttgatacgggtcttcactttaaagaaacatatgaaacgattgaaaaagtgaaagagcgttacccggggctgaacattatcctgaaaaagccaagccttactcttgaggaacaggccgaggctcacggagataaactgtgggaaagagaaccgaaccagtgctgctacatcagaaaaattctgccgttaagagaagcgctcgcggggcatccggcatggctgtccggtcttcgccgggatcaagggccgagccgggcgaatacgaatttcctgaataaagacgacaagtttcaatcgattaaagtatgcccgctgatccattggacatggaaagacatctggagatatacttccaagcatgagctggattacaatatcctccacgatcaggggtatccgagcatcggctgtgaaccgtgcacttcacctgcatttaccgcggaagatttgcggagcggcagatggaacggcatggcgaaaacagaatgcggactgcatgaataaaggagctgcacgatggaattagccgctattttattctgcctgttttttgccatgaatatcggagccagcggagccgcggcttcaatgggagtcgcttacgggtccggcgccgttaaaaagaaaacgtatgcgctgatcatttgcgcggccggagtcctgtcaggggcggttatcggcggcggagaagtcgttaagacgatcagcggcggaatcattcccgaacaaaccattacgctcaccattgtctgcattattatcggatcggcggcgctatcgttattcacggcgaatgtgctcggcattccgctgtcgacgagtgaggtcactgtcggggcgattgtcggtgtcggcgtcgcgtacaaagtattgtttttacagcatcttttggtcatcgtgagtttttgggtgctcgtaccgttcgtcgcgttctgtttcacgtttctcgtctcgaaggtattcagttctctgaatattcgagtcatttcgaatcggaaacagaagattttagggattgtgctgctgattgcggggttttgggaagctttttcagccggaatgaacaatgtcgcaaatgcggtgggccctttggttgctgcgggcgtgctcagcgtgtccaaaggaacgctgtacggaggcatctttgtcgctctcggcgctctgcttttaggacgtaaagtgcttgaaaccaacgggaaaaagattacgagattttcagccggagaaggcatactgctttcaggaaccggcgcggggcttgtcattatcagttccgtcttcggtctgccggtcccattggcgcaagtcacatcatcatcaattatcggcatcggaatggccaaaaacgggccgaacgtttttcataaagaagtcgtgaaaacgatgctcaaagtatgggtcgtttcgccgtttttgtcactgtcgatttcgtatctgcttgtctccctgctgttaaaaggagattactattccatctttatgatggccagcgtgcttttggcagctggcggagccgccagtctgatgaaagccatccgaaaagagaaacgctctgtccatgaacaaggcggaggcatttaactattaatctgagtttatttatctgttaactgggaggagtcatgtattatgagtttagcaccgcacggaggaacattaattaatcgggtgaatgagcagtatgatcttacatccgtccaaaaagaaattgagcttgatttgatttcgttcgctgatttagagctgatcggcatcggggggtacagcccgattgaaggatttttcacagaaaaagattacgtgtcagtcgttgaaaatatgcgtctggcatccggggttgtctggtccttgccgatcacgcttccggtcgattcagaaaaagcggctgagcttgccgtcggcgacacggtgaaactgacttacggcggagaaacatatggcgtcgtcgacatcgaagatatttatacgccggataaacaaaaagaagctgttcacgtatataaaaccgatgatgccgcgcatccgggcgtgaaaaaattattttcacgcggcgatacgtatatcggcgggccgatcacattagttaaaaaagcgtcaaagcagtttcccgagtttacatttgaacctgccgatacaagacgaagcttcgaagaaaagggctggaaaaccatcgtcggtttccaaacgagaaatccggttcaccgcgcccacgaatatatccaaaaaaccgcgcttgagacggttgacggcctgtttttgaacccgctcgtcggtgaaacaaaatcagatgacattccggcggatgtcagaatggaaagctaccaggtgctgctcgatcattattatccgaaagaccgtgttttcctcggcgtatttttggcggcaatgcggtatgcggggccgagagaagccattttccacgcgcttgtccgcaaaaactacggctgcacgcattttatcgtcggccgcgatcatgccggcgtcggtgattactacggcacatatgaagcgcaagagctgtttgatcaatttacagcggatgaactcgggattacaccgatgaaattcgagcacagcttcttctgccggaaatgcggcaacatgggaacggccaaaacatgcccgcatgacagagaagaccacgtcattctgtcaggaacaaaggttagagaaatgctgcgaagcggcgtcatgccgccggcggaattcagccgtcctgaagttgtcgaggtgttgattaaagggctgaaaacgaaagaagaatcaggcgtttcttaaggaggaaaatagagtgacaaatcgtgatatcgtgtggcatgaagcctcaataacgaaagaagaataccagcagaaaaacaagcataaaagctctatcctctggctgacgggcttaagcggttcagggaaatccacgattgcaaacgccgcagcgcgcgagctgtttgaacaaggctatcaagtcatcgtgcttgatggtgataacatccgccacggcttaaacaaggacttaggtttttccgatgatgaccgcaaggaaaatatacgccgaatcggggaagtggcgaagcttttcgttcagcagggaaccatcgtcatcacggcttttatttctccgttccgtgaggacagagatcaggtgagagagcttgtggcagagggcgaatttaatgaaatctatgtgaaatgcgacctcgatatatgtgaaaaacgcgatccgaaaggtttatataaaaaagcaagaaatggtgaaattccgttctttacggggatcgactcaccgtatgaagagccgaaagcgcctgagctcgtacttgattcaggcaaatgtgaacgcgaagaatgcaccggaagactggttgactttgtgaaaaacagcttagcataataggtccaaaaaggccgcgcaatcaaccggatatcccccctaatggcgggatatggtaaaatagctgaagtgcggcctcgcggctgttctgggaagatttcaaaacggatcggggagacatgctatggggaaagtatttatcgttggagccggtccgggagatccggacttattaacggtgaaggcaatgaaagccatacagaaagcggacgttatattatatgacagattggtaagcaaagagattttacagtatgccggagaagaagcggatctgatttactgcggcaagctcccggattttcacattatgaaacaggatacgatcaaccgtttccttgtgaagtatgcgaaaaaaggaaaaaccgttgtaaggctaaaggggggcgacccgtttgttttcggccgcggaggcgaagaagcggaggctctcgcgcaaaacgccattccgtttgagatcgttcccggcattacatcaggaatcgcggctgctgcttatgccggcattcccgtgacgcacagagaggcgagctccaatgtcgcattcgttacggggcattataaacaagaagacgactttgaagaaaaatggaaagcgctggcgacgggtattgatacgctggtgatttatatgggaattaaaaatatccggcagattgaaagaatgctgctggaaaacggcagagacgccggcaccccggcagcctttattcattggggaacgacggacaggcaaaaaacagtcgtctgcaccgtcggcacgctttcagacacagtgataaaagaagaaatcaaaaacccgagcttaattgttatcggtgatgtcgtcaattatcactgcaaactggactggtatgcatctgaacagaaaaatctggatttgagcgaggcgttgtaaatgaagcaggcgattttatacatcgggcacggaagcaggctgaaaaaagcgcagacagagtcggcggcgtttttaaaagggtgcatgccgcacgctgacgctcccattcaggaaatctgttttttagaactgcaggaaccgtctattgaagcgggatttgaagcatgtgtcagacaaggcgccactcatattgcggccgtgcctttgctgctgttgaccgctgcccacgcaaaacatgacattccggctgaaatcgcccgtgcggcggccctgcatcccgatataaaagtgacatatggtgttccgatcggagtggacgatgaagttgtaaaagcggtgcatcagcgcattgaagataccggagtgcccattgagcaggcgaaagtggtgctgatcggaagaggaagcacagatccggcagttaaaaacgcagtcagtaagattgccggaaaacttgaggcgattacacctgttaaagaagtcatcccttgttttttaacagcatgtgacccgcactataaagaagtgtttgccggccttgaagaggatgacggagcacccgtttttatcgttccatatcttctgtttaccgggcttttaatgactgagattgaacgggaagttcaaaagcttcaaacgatcaatcaaaatgttcatctcgcttcatacttaggttttcacccgcatattaagcaggcgtttttgaaccgtgtgtcagaagctgttcgaaaccccggcggccagtttgattttaaggggggacagtatgctgcctctgcacattaatctaagcggaaaaagaattatcatcgcgggcggaggcaatgttgccttaagaaggctcaaaacggtgcttccggaaggcgcggatattactgtaatcagtcccgatgccctgcctgaaatgaaacagctggcggatgaaggacgtattcgctgggtttcccgtaaaattgaaatgaaggatctcgcgcccgcttttttcatcattgccgcgacaaatgaccgcagcgtgaatcaggagatagccgcgaccgcttctgaaacgcagctggtcaattgtgtaagcgaggctgaacagggcagcgtgtatatgccgaagatcatccgcaaaggtcgcattcaagtatccgtatcaacaagcggcgcaagcccggcacatacgaaaagactggctgaggacatagagcctctcattactgctgatttggctgaagaagtggatcgtttatttgagaaaagaagaagatcataaaaaacaccttgtctgtcatcaggcagggtattttttatactgtcctgacagtccccgaatgtgaacaattcaaaacgaaagcgggcagtttgaatgttatatgccgacaagcggtcaggattgcgaagtgacgcggaatatttatctggtcccgatgccgcctggattccgcccgcatacaaaggaaaggtcagagacccgcccggatgtgctcaggttcggcgagggaaggtgacagtatccgccgccaaatcaggtgtgaccgttttaatcagagacggccccggcggatcaggcagacatgacgggaaactgatcagatactgtaaagatcggttctgacggctgggagagtttcgtctccgtttataagtaataaaaaacacctccaagctgagtgcgggtttcagcttggaggtgcgtttattttttcagccgtatgacaaggtcggcatcaggtgtgacaaatacggtatgctggctgtcataggtgacaaatccgggctttgcgccgtttggctttttcacgtgtctgatttttgtataatcaacgggaacggagccggaatctttcgccttggaaaaataagcggcgatcgcagccgcctccagtatggattgttcatccggatcgctgcttttaatcacaacgtgggaaccgggaatgtctttcgtgtggaaccataaatcatcccttgcggcagcttttgtcgttaagtattcattttgtttattgtttttgccgacaagaatcgtcaatccccgtgaagattcatattgctccaaaacaggaacgtgctgcttctgctttttctgtcctcgctgctgtttcggtcgcagatatttgccttccacaagctcttcccttatttcgtgaatatcctttgtggaggcggaggagagctgctggatcagctgatcgaaataagcgatttcctcctcggccagacggatctgttcttttaccacctcgacggaattcttagccttttgatactttgtaaaatacatctgcgcgttttctgacggtgttttgttcggatttaaaggaatggtcactgtcttactttcttcatcataataattgatgacttccgcttctttgtcaccttttttcagcatatataaattcgccgtcagcagttcgccgtatagctggaattccttcgcattctctgagtagtcgagcgtcttttccagcttttttatcttattggcgttctttttccgttcatttgcgacaaatcgctcgagatcctgagcctgctgtttgacgcggtcgcgttccgccttgccgaaataaaaccggtccaacagctcactcagtgagtgaaaggtgcgctcctctccgtttacatgtgtgagagacaggagataaaagtattcctttccgccggctgttgtaatgtttggtgtaaacctgcaatctttcacggcatggaacatttcaatcagcgtcttcggcagcgttattttgttagcgagacccgctctgtgaacggcttcttttgcaaacagcggagaaacaccggagaaatgtctgacgatctgctggtcaagccgtccttcctgaaaactgagataacgcaaaacgtcttcttcgtccgcggcgagcggcgaaattttttcctgagcgggaggaagcttgtaatcatagcccggcagaacggtccggtagctgttcatcgacggagataaatgtttcagcccgtcgatgatggctccttctccgtcagtcaggataatattgctgtgccgccccataatttcaacatacagcgttcttacggtttcgtcgccgatttcatttctgctttttatgcggaatatcataatccggtctaatccggcctgttctattttctcaataaatccgccttctatatgctttctgagcagcgtacaaaacatcggcggctcgctcggattttcataggcctgattcgtcatgtgcacccgtgaatagctcggatgcgccgataataataatttatggttttttccgttagcgcggatatggaatatcacatcgtgcttaaaaggctgatggactctcgtgatccggcctccggcaatccggctgtttaattcatgtgtcattccgtatgtaaacatgccatcaaaagacatataaaacaccctttccttcttcctgcattcgataattatagcatgaaaagggacgagtcagaataagcttgtttacagagtgacatctctaaagcgaggcaggggagtggacgagaagaatgaagtttcatgaaatgggacaaaccgatttgctgaaagcaacaaatacgtccattaaacaggggttgaccgaaaaagaggtgaaaaaacgccttgaaaagcacgggccgaacgagcttcaggagggcaagaggacaccggcgatcgccgtgtttttcgcccaatttaaagattttatggtgctcgtgctgctggcggcaaccttaatatccgggtttttaggcgaatatgtagatgccgtagcgattatggcgattgtatttgtcaatggggttctcggtttttttcaagagcggcgggcggaaaagtctttacatgcattaaaagagctgtcaacgccgtatgtgtcagcgttgcgggacgggagctggaagaaaattcagtccaaggagctcgttcccggcgatatcatgaaattttcaagcggcgaccggattggcgcggatgtgcggatcgttgaagcgaaaagccttgaaattgaggaatcggcgctgaccggggaatcaattccggtggttaaacaagccgataaattgagaaagccggatgtttcgttaggcgacatcagcaatatggcgtttatgggtacgatcgtaacgcgcggcagcggtgtcggcgttgtcgtcggtacaggaatgaatacggcaatggggaaaatcgccgatatgctggaatccgccggcagcctttcaacaccgctgcagcgaagacttgaagagctcggcaaaattttaattatcgtcgcgctccttttaacggtattggtcgttgcagtcggcgtcttacagggacatgatctttacagcatgtttttggccggggtgtcattggccgtcgccgcgattccggaagggcttcccgccattgttacggtggcattatcaatcggcgtccagcgcatgatcaaacaaaaatcaattgtcagaaagctcccggcggttgaaacattgggctgcgcctctgtcatttgttctgataaaaccggcacgctgacacaaaacaaaatgaccgtcacccatatgtggtcaggcggcaaaatttataaagtgtcgggcatcggctatgtgccggagggcgttttcactcgcgatgagcgggaaatcaagccgaaagatgagaagattcttgaacagatgctggttttcggcgcgttgtgcaacacatctgaaatctcactgaaagacggccgttatgtactcgacggtgatccgacagaaggagcgctgctgacggctgcaagaaagggcggctattcaaacgattggctcagcgggcaataccgcgtggttgccgagtttccgtttgactccgtccgcaaaatgatgaccgtcattatagaggataaggaaaaaaagcagttcgtcatcactaaaggagcgcccgatgtgctgattgaccgctcgtcacatctgatgcacggcgcaagaagtacgcctttttcaggagaaaagaaagcagaaacggaagcggttctgaaagagctggcgtcgcaagctttgcgtacgatcgcgattgcttataaaccgcttaagcccggagaaaagccgacaatggagcaggcggaaaaaaatctgacgatgctcggcttgtcaggcatgattgatccgccccgtccggaggtcagacaggccattaaagaatgccgtgaggccggcattaaaacggttatgatcacaggagatcacgtcgaaacggcaaaggccattgcaaaagatttgcgtcttcttccgaaaaaggggcgtgtgatggacggcaagacgctgaatgagcttacggagaaagaacttatcgaaacggtcgatgatgtctacgtcttcgcacgcgtgtcacctgaacataaattgaaaatcgtcaaagcgtttcaggaaaacggacacgtcgtcgccatgacgggagacggggttaatgacgcgccggccataaagcaggcagatatcggtgttgccatgggcgtgacgggaacggatgtggcaaaggaagcctcttctctcattctggtggatgataactttgctacgattaaatcagccataaaagagggacggaatatctatgaaaatataagaaaattcgtccgatatttgctcgcctccaacgtcggtgaaattttagtgatgctgtttgcgatgcttctcgctctgccgctgccgctcgttccgattcagatattgtgggtgaacttagtcactgacgggctgccggcgatggccctcggtatggatcagccggaaggagatctgatgaggcggaagccgcggcatccgaaagaaggagtgtttgcgcgaaaactgggctggaaagtcgtatcaagagggtttttaatcggagccgcaaccattttagcgtttatcatcgtctatcaccgcaatcctgaaaatctgccctacgcacagaccgttgcattcgcgactcttgtcctggctcagcttatacacgtgtttgactgccggagcgaaacgtctgttttctcccggaatccgtttgaaaatatctatctgctcggcgccatcatttcttctatcttcctgatggtcatcgtcatctattatccgccgctgcagccgattttcaaaacagtgccgattacgccgggcgattggatgctgattatcgggatgtcgggcatacctacttttttgctggcgggttcacttttgacaagaaaaaaataattccatatgatataatcttaggggtaatagcatgtctattgcccttttattttgataacgggaaagaattgggtgtttcatatgatacggagtatgacaggcttcggcagcgcaagcagcacaaaaggcgatctctcggcaaccgttgaattgaaatccgtcaattaccggttcaaagaagtgaacgcccgcctgccacggcctttgctatatgtagaggataagctgaaacaaacgatattgcagcatatacagcgcggaagagtagagctgtttctcactgtaaacagtgacgcgctcataaaaagaagcctgaacatcgattgggagctccttgatgaatatgtgagcgccgcacgcgtcatgaaagagcgctacagcctggccgcagaacccgatgcaatggatttctttaaatttgaacatattgcgcagatacacgaagaacagatgcgtgatgacaagcttgaagaagtcatcagggaagccgctgaactggctgtaaaggaactttgtgacatgagggaaaaagaaggacggcttttggcggaagactgctttctgcacattgagcggcttgagacgctgtccgaacaggtgaaagagcgcgcttcggccgttgttattcaataccgcgagcgtctttacgcccgaatgaaggaatggacggaggacgcactcgacgaaagcaggctgatcacggaatgcgccattttcgccgaccgttctgatatcacggaagaaattaccagattgaagagccattttgttcaattccgtgatatattaaaagaaggcggggcagtcggccgcaaacttgatttccttgttcaggagcttaaccgggaagcgaacacgatcggctcaaaagccaatgatcatcaaatcacaaagcttgtcgttgaaatgaaaagttctattgaaaaattgaaggaacaagtgcaaaatatagaatagcgactgtgcgtattgtttacagacggtctcttcaggttacactagagacgtctattttacagggggaacgtagaagatgacgattaaactgattaatatcggatttggcaatatcatctccgccaatcggatgatttcgattgtcagcccggagtctgcgccaataaagcgaatgatccaggatgcaagagaccgcggaatgctaatagacgctacatacggacgaagaacccgtgcagttgtcgtcatggatagtgatcacattatcttatctgccgtccagcctgagacagttgcacacagactttctgtgaaagaagaaattatggatgaagggcaggggtaattgccgcatgaaagaaagagggttattaatcgttctctcaggtccctccggagttggaaaaggaacggttcggcaagcaatattttcacaacaggacacaaaatttgaatactcaatttcagtcacgacgagaaacccgagagagggcgaggtcgacggcgtcgattatttctttaaatctagagatgaattcgaacgcatgattgaaaacaacaaactgcttgagtgggcggaatatgtcggcaactattacggaacgcccgttgattatgtcgaacagacgcttcaagaaggaaaagacgtcttcttagagattgaagtgcagggcgcgctccaagtgcggaatgcatttccggaaggcctgtttatcttcttagcgccgccgagtctttctgaactgaaaaacagaatcgtgacaagagggactgaaaccgacgatttaatcgaaaacagaatgaatgccgcaaaagctgaaatcgaaatgatggacgcgtatgattatgtcgttgaaaacgacgatatccaaacggcttgcgataagattaacgcaatcgttctcgccgagcacttaaaacgtgaacgcgtcgctccgagatataagaaaatgctggaggtagaataacttatgttagatccgtcaattgactctttaatgaataaattagattctaaatatacgctggtgaccgtgtctgcaagacgcgcgcgtgaaatgcagatcaaaaaagaccagcagattgaacataccatttctcacaaatatgtaggcaaagctttagaagaaattgacgcgggcctgctttcgtttgaaagagaagacagcgaataacaagcacacgtagcaacctatctctacataggttgttatttttttccgtttgggatttgtccaatgctttcataaaggggagaagacttcatgaaaaaccgaaacattctgctatgcgtaagcggaggaattgccgtttataaagcttccgcactcacgagcaagctggttcaggccggcgcaaacgtcaaagtgattatgactgagtccgcgcgtgagtttgtttctccgctgacatttcaggcgctgagccggaatgaagtgtatacagatacatttaatgaacagaatccgaaggtgatttctcatattgatgccgctgactgggcggatttaattattgtcgcgcccgctacggcaaatatcatcggcaagcttgccaacggaattgctgacgatatgctcacaacgacggtgctggcggctgaggccccggtctgggtggcgcctgcgatgaatgtccatatgtatgatcatccggcggtgaaacggaatatctctgtgctttatcaggacggggtccgctttatcgagccgagtgaaggctatttggcatgcggatatgtcggcaaaggaaggctggaggagccggagcttattgttgagcgtgtcagagagcattttaaggagcctgaagacgatgcgccgctgaaaggaaaacatattgtcattacggccggtccgacgcgcgaagccgtggaccctgtccgcttcttcacaaataaatccaccggcaaaatgggctacgccgctgctgaagccgccgtccgtctcggagcgcgggtgacgctgatttcaggtccggtgtcaatagagccgccagtcgggctgtatcagtttcttcctgtgcaatcggcagctgatatgaaagaagccgtgctttctgtgtttgattcatgcgacatggtgattaagacggcggccgtggccgattttacgccggcggctgtttctgatcacaaaatgaagaagaaagacggttcgctcgtgatcgaattcaaccgtacggcagacatactgaaagaactcggcgaacggaaaacacaccagctgctggtcggatttgcggctgaaacgcaagacgtcgaacgctatgcgcgcagaaaactcgaacagaaaaaccttgatatgatcgttgcgaataatgtgaaagcggaaggggccggatttggcacggatacgaatgtcgtcaccttctatttccgggacggaagaaaacgggagcttgcgcttatgtctaaacttgatgtttcctttgaaatgctgaaggaaatgaccgctttgaaagccgaggaccgaaaaccggtatgaatgtagcagaagtcattgtcgatgtcagctccaaaaacattgacagaccctttgattacaaaattcccgatcatttaaaagggatgatcgaagtcggcatgcgggtgattgtcccgtttggcccgcgcaagcttcaaggatttgtgaccggtttgaaagattcgtctgaattaaacggcggctcaatgaaggaagtcgagaagcttcttgatttgacgcccgttctgactgaggaactgatgcagctgtcttcatggctttctgacaaaacgctgtcgtttaaaatcacggcgcttcaggcaatgctgcccgccgcactgaaggcgaagtacgagaaagagctgaaagtcgttgacgaagaagcgctgacaccggacatcaaacagcttttcaggaatcaaaaaagtcttctgtactcggatattaccgatgaaagcattctttcgtcacttcagaaattcgtgcgcaaaggaagcattgatgtcacatataaagtcgcccaaaaaacgaataaaaaaatgatccgcatgatcgaagcgggggcagacaaagaagaactcgcccggcacgcagattcattgacaaagcaggcttctaaacagctcgccgtgcttacttattttatcggcgggggagcaaagatttccgcggccgagctttgcaaaaagaccgattccagttccgcgacgctgaaaacgcttcttaaaaaggggcttcttacggaaagctttgaggaggtttaccgcgatccttatcaggacagaatgttcaaaaaaacagagccgctctctcttacagaagagcagcaggccgcttttgagccgattaaacaagccgtagccgatcatgtccatcacgtctttctgcttcacggcgtcacgggaagcggcaagacggaaatttacctgcaatccattgaaaaagtgctggcaaaaggacaagaagctatcgtgctcgttccggaaatctcgttgacaccgcaaatggtcaaccgttttaaaggccgcttcggctcgcaggttgcggtcatgcacagcggattatccacaggtgaaaaatacgatgaatggcggaagattcagcgcaaggaagtccggcttgtcgtcggagccagatcggccatctttgccccgtttgaaaatctcggcatgatcattattgatgaagagcacgaatcttcctataagcaggaggaaatgccgcggtatcatgcaaaggacgtagccatccaccgggccgagcatcacagctgtccggtcgtcctcgggagcgccacgccgacattggaatcatttgcgcgggcgaaaaaaggcgtttatgagctgcttccgttaaaacatcgcgtaaatcgccagctcatgcctgacgtttctctcgttgatatgagagaagaactgagaaacggcaacagatcaatgttttcaagagagctgatggaacagctggaagagaagcttgcaaaaaaagagcaggccgtccttttcctgaataaacgggggtattcctcgtttgtgatgtgccgggactgcggttatgtgccgcaatgtccgcattgcgacatttcaatgacttatcaccgctacggacaaaggctgaaatgccattactgcggccatgaggaacctgtcccgggaacatgcccggaatgcggcagcgaacatatccgctttttcggcacgggcacgcagcgtgtggaggaggagcttaccaaagtgctgcctcaggcgcgcgtgatcaggatggatgtggacaccacttcaagaaaaggcgcccatgaaaaactgttgtcagcgttcggtgaagggaaggcggatatcctgctcggtacgcaaatgatcgcaaaagggcttgattttccgaacgtgacgctcgtcggagtattaagcgcagatacgacgcttcacatccctgatttcagggctgcggagaagacattccagctgctgacgcaggtaagcggacgggccgggcggcatgaaaagccgggaacggtggtcattcaaacgtatacaccgtctcattacagcattcagctgacgaaaacgcacgactatgaaactttttttcagcaggaaatggcgcacagacgggcccagtcatacccgccttattattacgtggcgctggtgaccgtttctcatgaagaagcggcaaaagccgcggtcaccgcagaaaagattacaaactatttaagagcgggatgcgggcctgatacgaaaattctcgggccggcggcttccccgatcgccaggatcaaagatagatatcgctatcaatgcgtgataaaatacagacaggaaaacgagttgcagattcagttgaaaaagatactggagcactataaacgcgacattgcgcaaaagcatgtaatgatttcaatcgatatgaatccgtacatgctgatgtaacattagtttttggagggcaaaattttggctgtgaaaaaaatcgtcacacacccggcggaggttctggaaacacctgccgatgaagtgacagtgtttgataaaaaattaaaaaaactgcttgacgatatgtacgatacgatgctcgaaatggatggcgtcggcctcgccgcgccgcaaatcggcattttaaaaagagcggccgtcgtggacatcggtgaagaaagcggccggatcgaccttgtaaatccggttattcttgaaaagagcggtgaacagaccggagtcgagggctgcttaagctttcccggggtttacggcgatgtcacccgcccggattacgtaaaggtaaaagcccacgaccgtaaaggaaaaccgtttattttagaagcggagggttttttggccagagccgttcagcatgaaatggatcatttagacggcattttattcacatcaaaaattacggcttactacactgaagaagaactggcagaaatggaaggatgattggatgacaaggatcgtttttatgggaacgcccgacttttcagttcccgtcctgcgcacgcttattgaagacggatatgaagtggttggtgtcgttacgcagcctgaccgcccgaaaggcagaaaaaaaatcatgacgccccctcctgtaaaggctgaagctgaacgtcacggcattcccgtgcttcagcccgaaaaagtaaggctcgaagaagaaatagaaaaagtgctcagcctgaagccggacctgattgttacggcggcattcggacagatcctgcccaagcagctgctggacggcccgaaatacggctgtatcaacgtacacgcgtcactattgcctgaattaagaggcggagcgccgatacattattcgattctccaaggcaagaagaaaacgggcgtgacgatcatgtatatggttgaaaagcttgatgcgggcgatatgatttcgaaaatcgaagtggaaattgatgaaacggataacgtcggcacgctacacgacaaattaagcatagcgggggcaaagcttttgtcagagaccgttccgaacgtcatttccgggaatattaaaccgatcaaacaggacgaatcaaaagcgacttacgcgcctaacattaagcgtgagcaggagcggattgattgggcaaagcccggagaagagatttacaaccagatcagaggtttaaacccttggcctgtcgcctatacaactttgaacggtcaaaatattaaagtatgggcttctgaaaaagttgcggcaaaaactgaagctgcgcccggaacagtcatccgcacggagcaaaacggcattgtcgtcgcatcaggaaacagcaccgcccttttaatcacagagctgcagccggcgggaaaaaaacggatgaagggcgaagattttgtaaggggcaaaaatgtgcagcccggtgacgtgttaggagaagcaaatgaaaaaaattaatgtccgggagctcgcccttgaagcgcttgagaagcttgagcaaaatcaggcatacagcaacctgcttcttacatcggttatcaaaacgaatacgctcagcgatcaggacagaggactgctgacagagcttgtctacggaacgctgcaaaataaaatcgccttagactttatgctgaagccttttatccgcaagccgaataaggtgaagccgtgggtgattcagctgcttcgtctgtccgcgtatcaaatggagtatttagaaaaaattccggatcgcgccgccatccatgaagcggttgaaatcgccaaaaaacgcgggcataagggcattgcgtcctttgtcaacggcatcctccgctccctgcagcgtgagggggcgccgtcattcgctgaaattgaagacccggttctccgtctttctacagagacaagccatcccgaatggctcgtaaaagagtgggtcgaggcgtacggctttgaggcggctgaaaagatctgccggattcatctcattccgccgaagcagacgctccgtgtcaatcacataaagagcgacagggaaacggtgctgaatgagatggagaatgccggtctggaagcagaagccggagacctttctcctgatgcgattaagcttttaaaaggaagcatcgcgaacacggcatttttccaaaacggccgggtatccatacaggatgaaagctcaatgcttgtcgcgcgggcgctggacccgaagccgggcgaaaccgttttagacgcatgcgccgcaccgggcggaaagtcggctcacattgcggaactgatggagaacgaggggagcctcacatcgcttgatcttcaccgccataaagtgaagctgattaaagagggcgcagaacggctcggacttacgatcatcgatgcacaaacgatggatgcgcgaaaagcgggagaggcctttggcgcagaacggtttgaccgtattctcgttgatgccccttgctcaggtttcggcgtcatcagaagaaaacccgatatgaaatatacgaagacgccggaggacagcagacggctgtcagaaatccagctcggcattttaagggaaatcgccccattagtaaaaaaaggtggcacactcgtatacagtacgtgtacaatggaccggacagaaaatgaagaagttatgcatgcgtttatacaagaacaccctgagtttgaacccgatttgtctcttgaaaagcggctgcctgaaaaggcgagaccctttgttcaggatggaagccttcaaattcttccgcattatttcggaacagacggtttctttattagcagcatgagaaagaagggataaaaaatgacacaattaaaaaagacaagcgtacggaaagagctgcggactgagcagccgtccatttactcttttgaattagatgaaatcaaacaatggctgactgagaatggcgaaaagccgttccgcgcggcacagatttttgaatggctctatgaaaagcgggtttcttcatttgatgaaatgacaaacctctcaaaaagcctgcgtgaaaaactccagagccattttgtgctgacaacgctgaaaacggctgtaaaacagacatctcaagacggcacgatgaaatttttatttgagcttcatgacggttatacgatcgaaacggttttaatgagacacgagtatggtaattctgtatgtgtaacgacacaggtcggctgccggatcggctgcacattttgcgcgtcaacgctcggcggtctgaaacggaatcttgaagcgggagaaatcgtcgctcaagtcgtgaaagtgcaaaaggcgcttgatgaaacggatgaacgcgtcagctcagtcgtgatcatgggaatcggtgaaccttttgataactttaacgaaatgctcgctttcttgaaaatcattaaccacgataaagggctgaacatcggagcgcgtcatatcacagtttccaccagcggaatcattccgaagatttacgatttcgccgatcaaaaaatgcagatcaatttcgcgatttctctgcatgctccgaatacggaaatcagaagccgtctgatgccgattaacaaagcctataagcttcctgaccttatggaggccgtcaaatattacatcgagaaaacaggcagacggatcagctttgaatacgggctgttcggcggcgtaaatgatcaggtcgaacatgcagaagagcttgcagaactgttaaaagacgtgaaatgccatgtcaatttaattccggtaaactatgtgcctgaacgggattacgtccgcacaccgagagatcagattttcgcattcgaaaaaacgttaaaatcccgcggtgtaaatgtcacgatcagaagagagcaaggccatgacattgacgcggcctgcggtcagcttcgcgcgaaggagcgtcaagacgagacgaggtgaagaggttgattacagccttgaaaacagatacaggtaaagtccgccggcataatgaagatgcggcgggcattttcacaaaagaagacgcggtgcttgcggttgtcgccgacggcatgggcggtcatcttgccggagatgtagcgagcaggatggcggttgcggcgatggaagagcagtggaaccggaccgaaacggttccttctctgccgtctgcttgcgaggattggctgaaagaccggattcatgaggcgaatgtcaaagtacatgaccacgctaaagcgaatgaagaatgccggggaatgggcaccaccgttgtttgcgccttattcaccgggaagtttgtcactgtggctcatatcggtgacagccgatgctacctgcttcaagatggggaattcactcagctgactgaagaccattcgcttgtgaatgagctggtcaagacgggggaaatttcgaaagaggacgccgagcaccatccgcggaaaaatgtattgacgagagcgctggggacagatgaaaccatcagttccgacgcccgttcttttgaactgtctgacggcgatcagctgcttttatgctctgacggactgtcaaataaaatagaagatcacgagatcaaacaaatgcttcaagccgaatctgatcctcaggaaaaagtagaccttctcatcagcaaagcgaatcaaaacggcggcgaagataacatcacggctgtgttgattgagttttccgcagatgcaaaagagggtgaagacaagtgctaaccggcaagcggatcagcgggcgttatcatatcctccggcccattggcggcggcggaatggcaaacgtttttttagctgaggacatcattctcgaacgtgaagtcgcaattaaaattctgcggtttgactttgtgaatgacattgattttatcaggcgtttcagaagagaagcacagtcggcatcaagcctcgatcatccgaatatcgtcagtatttacgatatcggggaggaaggcgatatttattacattgtcatggaatatgtggaaggcatgacattaaaggaatacataaccgcacacgggccgcttcatccgaaagaagcgctgtccgttatggagcagatcgtctcggccatcgcccatgcccatcaaaaccatatcgtgcaccgggatattaaaccgcacaatatattgatagatcatttagggcatatcaaggtgacggatttcggcatcgccacagcgcttacgtctacgacaatcacacatacgaattctgtgctgggctcggttcattatttgtctccggagcaggcgagaggcggtctggcaacgaaaaaatcagatatttacgcgctcggcatcgtgctgtttgagcttttaacaggtaagatcccttttgacggagaatcagccgtcagcatagcgctaaagcatctgcaaacagaaacgccttccgccagaaagtggaacccttccattccgcagagcgtcgaaaacattattttaaaggcaaccgctaaagacccgtttcaccgctatgaaagcgccgaggacatggaagcggacatcagaacggcttttgacgccggcaggctgaatgaacaaaaattttccgttcaggatgatgaggaaatgacaaaagccattcccgttattgctgacggcgcaaaagccgcgcctcaggcggaaacgccgggggagacggatgataaggaacagcagcccgccaaaaagaaaaaacggaaatggccgtgggttttgctgtccgtctgtttcattttcattatggcggctgttcttgctgtcactgtgttcccgtctttatttatgcctaaagatgtaagcgtccccgacgtacggggcatgaagtacgaaaaagcggaagcactgcttgaaaagaacgggctccgggcggatcctgatataacggacattgaagatgacaaaatagaagaggaattaatggtcaaaacggacccaaaagcggggtctaccgttaaagaaggctcttctgtaaaactgtacaaaagcatcggaaaaccgaaaacccagctgatcgacgtgaaagggcggcagatcggcgacgcaaaaaaagcgctgaaggacaaaggcttcaaacatgtcaatgtcaaagaagagaacgatgacagcgaggccggcaccgtaattgatcaggacccgtcagccggcaccgacatggtcggaagcgacgatgaagtcaatctaacggtcagcctcggcccggcggacgttacgctgagggacttaaagacttacagcaaagaagcggcttcagggtatcttgaagataacggcctgcagcttgttgaaaaacaagcccattcagatgacgtgccaaaaggacaagtcatgaagcaagagccggcagccggcactgcggttaagccgggaagtaatgttgaagtgacgttctcgctcggacctgaagaaaaaccggcgaaaacggtaaaagaaaaaatcagcattccttacgaacccgaacatgaaggggacgagcttgaagtgcaaatcgccatcgatgataaggaccacagcatctctgatacgtatgactcatttaaaataaaagagccgactgaaaaaacaattgaactgaagattgatcagggacagaaggggtattaccaagtgatggtcgatcataaagtcgtcagctacaaaacgattgaatacccgaaagataatgactgacaaggagggaccctatgcctgagggcaaaattataaaagcgttaagcggattctattatgtcttggatgaatcacaggacaagatcattcaatgcaggggccggggcattttcagaaaaaataaaataacgcctctggtcggcgattatgccgtttatcaggctgaaaatgataaagaaggctacttgctggaaatcaaagaacgaacaaacgagctgatcaggccgccgatttcaaatgtcgatcaggccgttctcgtcttttctgccgttcagccggcgttcagcacgtctttattggaccgttttctcgtccttgtggaagccaacggcattcacccgatcatctgcataaccaaaatggacttagctgcagacggggaatcgaaagaggcgatactttcttacgtgaaagactatcaggggatcggttatgacgtatatgtgacgtcatcaaaagaaaacagcggtttaacaggcattgtgaaacacttcgagaacaaaacgacggtgtttgccggtcagtcgggagtcggaaaatcttcgcttttaaatgcgatcagcccggagcttgagctgaaaacaaacgagatttccgcgcatttgggacgcggaaaacatacgacgcgccatgtggagctcattcatacatcaggcggtctggtggcggatactccggggttcagttcgcttgaatttaccggcattgaggaagatgagctgggcagcacgttccctgagatcagagaaataagcgcctcttgcaaattcagaggctgtctgcatcttaaggagccgaaatgcgcggtaaagcaagcggtggaagaaggagagattcagccgtaccgttatgagcattacaaagaatttatgcaggaaataaaagagagaaagccgaggtattaatatgattaaggttgcgccatcaattctttccgccgattttgcttcactgggcgaggaaattaaagacgtggaaaaaggaggggcggactatatccatattgatgtcatggatggccatttcgtccctaacattacaatcgggccgcttatcgttgaagccgtccgtccggtgactgatctgccgctggatgtccatcttatgattgaaaacccggaccgctacataccggcattcgcaaaagccggcgcggacatcctttccgttcatgctgaagcgtgtccgcatcttcaccggaccattcaattgataaaagagcagggggtaaaagcgggagttgtgctcaatccgcatacgcccgtccaaatgattgaacatgtgatcgaggaacttgaccttgtgctgttaatgacggttaaccccggttttggcggccagcgcttcattcattcggttctgccgaaaatccgtcaggtcaaacagctggctgaggagaaaggcctgtctgagcttttaatcgaggtggacggaggcgttaataaagaaacagcccctttatgcgctgaagcgggcgccaatctgcttgttgccgggtctgccgtatataatcagccggatcggaaaaaagccatcgctgacatccgaaacgcgtaataaacatgctgaaaaagagcccggtgaaagccgccggctcttttcgcgtctaagagagaggaaaacatatgaagacaatcaatatcgttgcgggcggcccgcgggaacttattcccgatctatccgaatacacagacggagatacgacgtgggtcggagtcgataaagggacggtttctcttttggaagccggaatcattccgcaggaagctttcggtgattttgacagcattacggaagaggagctcatgcagattcaaaaagcggcgccggccctccatgtgtatcaggcggaaaaagattataccgatcttgaactcgcccttgactgggctttacaaaaagaaccggaaaccattcggatgttcggtgtgacgggcggaagagccgatcactttttagggaacatccagctgctgtataaagccttacataagaataccgatgtcgagctgatcgaccggcagaatgacattcagatgttcgggcccggccgttatacaattgaagaaaaagcgcgcagacgctatatttctttcattccatttacggaagcggcagacggcctgacactcgacggttttaaatatccccttgataattgtcatattcctctgggttccacactatgtattagtaacgaactcattcattcacgaggtactttttcgtttgcaaaaggcatattaataatggtaaggagcgcggattaaaaagcggcttctgccatatgcggaaaaaaccatgaatcctaaagtgatgaacgcagcggatacgggacttataggaggggacaaaatgaaattttataccattaaattgccgaagtttttaggaggaattgtccgggcgatgctgggctcatttagaaaagagtaagcccaagaagctgaaattgccctctttgaacgcataaaaaacgcctgccgcataaaagggcaggcgttcatttttgcttatacacgctcaactttaccggattttaaagcccgggcagatacatacacttttttaggtttgccgtcaacgaggatgcggaccttttgaaggttggcgccccaagtacgcttagaagcgttcattgcgtgagaacggttgtttccggcttttgtttttttacctgtaataaaacatttacgtgccatttgtttccctcctaactgcgcgaaacatcttttcaaacatagtttctcagatgctttcgttatacaatactttaaataatttaccacagctaaaaaccgtttgcaactattgtttcccttactttcaagaaaaatcacttgacatgtaaaaccaatcacatttccgcgctgaaggccgctgtctgtatcttttcttttcataatgggatacatatagtagaataatgataactctatgcacctgaaggaggaacctgtgtgtccattgaaatgaagacaaaatacggacagattgatatatccaacgaagtcatcgcaatggttgccggaggcgctgccattgactgttacggaatagtggggatggcctcaaaaaaccagattaaagacggtttgtctgaaatcctccggagagagaacttcgcaaaaggcgtacatgtccgtcaggaagccgaacaaatacatatcgacatgtacattattgtcagctacggcactaaaatatccgaagtagcccacaatgttcagacgaaggtaaaatacacagtaaatcaaacaatcggacttgcagttgattctgtaaatatttatgtccaaggcgtacgagtaacgaacccgtagtgaggaggatgagtattgtctagacgaaacttagatgggagagcttttgcggcaatgattctggcgggggctgagacattgtctcaaaacgcatccgcggtggatgcgctgaacgtgtttcccgtgcctgacggcgataccggaacaaatatgaatttatcgatgtcatccggtgcaagagaggtagagcacattgactcacccgacatcggcaaagtcggcatcgccctgtcaaaaggcctgcttatgggagcgagaggaaactcaggggtgatcttgtcccaattgttcagaggtttcacaaagagcattgaaaacaaaaaccaaatagacgcccaagaatttgccgcagcactccaagcgggagtggatatggcatataaggcggtcatgaaaccggttgaaggaacgattttaaccgtggctaaggatgcggctaaaaaagcggtcgcctcggccaaagaagaaaccgatattatttcggtcatggaggccgttattgaagaagcggaagcgtcgctgaaccgcacgccggatctgcttcctgttttaaaggacgtcggtgtcgttgacagcggcggaaaaggtctgctttgtgtatatgaaggctttttggctgctttaaaaggagaggccgtaccgaaaaaagcggttcttccggcactcgatgatatggtgaatgccgagcatcataaaagcgcgcaaagcatgctgagtacagaagacattgaattcggattttgtacggaagtgatggtgaggctggatcaagataaacggacgttcaaggaagagacgttcagaaacgaactgagccgtttcggcgattcattgctggtcgtggctgatgatacgctggcgaaagtccatattcatgccgaagaaccagggaacgtactcaatctcgcacagcgttacggcgatttgattaaaattaaaattgaaaacatgagggaacagcatacttcaatcatcagccaagaacatgatgaaaaaaagccggccggcgttatgaaagaagcccgcaagccttttggcatcgtgactgtggcaatgggagagggcatttctgaattgtttacgagcatcggcgcttcacacgtaatcgaaggcggccagacaatgaatccgagcacggaagatattgttgaagccgttcagtctgtcaatgcggagacggttttcattcttccgaacaattccaatattgtgatggctgccaatcaggcggcgagcgtggctgaagaaaatgtcattgtcattccggcaaaaacggtccctcaaggcatgaccgccctgcttgcgtttaaccctgaccagccggctgacgtaaatgaagccaatatgcttgaggccatccggaatgtgaaaagcggacaggtgacatattcagtcagagacacccatattgacggcaaagatattaaaaaaggtgattttatcggcattttaaacagttcaattatcggcagcgccgaagatcggatgagtgcggcaaaattgctgctggatgaaatgatcggggaagaagatgaaattgtcaccatcttgtacggagaggacgctccggaagaagaagctgagaaactcgctgagtatattgctagcgtctgtgaagatatcgaggttgaaatccataacggcagacagcctctgtatccatatatatttgcggcagaatagaagggcttatcaggcccttctattcttatgtctttatttacctgcggcagtgcggcagtgtgcctgcttgccaattgagaaatgttcaattagtctaaagaaaagcgctgaatgaagtgatgttaaggaggaacaaaccagcatgaagtatagaagcgtttttgatattatcggcccggtaatgatcggtccgtccagttcacataccgcaggcgccgcccggatcggcagagtggccagaagcctattcaggcgggagccccgccggatcattgtgtctttttacggatcatttgcggagacgtataagggtcacggcactgatgtcgcgattatcggcggcctgcttgattttgatacatttgatgaacggattaaaacagcgattcaaattgcggaagagaagggcatatatgtagagttccgtacagaggatgccgtgcccgttcatccgaatacagcgcgtatcgtcatttctgatgatgagggagagcttgcccttaccggtatttccatcggcggcggaaaaatagaaatcacggagctcaacggctttgagctgcgtctttccggaaaccatccggctattttagtcgttcacaatgataaattcggcacgattgcaggcgttgccaatgtgcttgcgaaattctccatcaacgtcggacatatggaagtggcgcgtaaggacgtcggccagcttgcgctgatgacgattgaggtcgatcagaatattgaagaagaagtgcttgacgagctttcaacacttcctaatattatacaggttactaagatagctgactaaaaagtcaggaggaaaatgacatgtttcgtaatgtaaaagaattaatagaaatcactcaagaaaaacaaattccgatttcggaagtgatgatcacgcaagagatggaagtgacgcaaaaaacgcgggaagaaatctttcaaggaatggagcgcaatctctccgtcatggaagcagctgttgaaaaagggctgaagggcgtcacgagtcagaccggtttaacaggcggagatgccgtgaaacttcaggcatacatccaatcgggaagaagcctgtcgggcaatctgattttagacgccgtttctaaagctgtcgcgacaaatgaagtcaatgcggcgatgggaacgatctgcgctacaccgaccgccggctctgccggggtcgtgccgggaacgttattcgccgtaaagcataagctgaaccctacgacagaacaaatgatccgttttctgtttacagccggcgcgttcggttttgtcgtagcaaacaatgcgagtatttcaggagcggcaggaggctgtcaggcggaagtcgggtcagcatcaggcatggcagcggctgcgattgtggaaatggcgggcggaacgcctcagcaatcagcggaagcaatggcgattacactgaaaaatatgctcggtctcgtatgtgacccggtcgccggattggtagaagtgccgtgtgtcaaacgaaacgcaatgggagcatccaacgcaatgatcgcggcggatatggcgctggccgggattacaagccgcattccttgcgatgaggtgattgacgcgatgtacaaaatcggccagacaatgccgacagcactgcgtgaaacgggacaaggcggtttagccgcgacaccgacgggaagagaattagagaaaaaaattttcggaggagcgctgaaatcaagtgacacaccatcagcaaactagtatagcggaaattaagggcattgggccggaaacagaaaaaacattgcacgaacttggtatctatgacatttctgatcttctgaattatttcccttaccgttatgacgactatgagctgagggatttagaagaagtaaaacatgaagaaagagtgacggtagaagggaaggttcattcagaaccttctcttacctattacggcaaaaaacgaaacaggctgacattcagggtgcttgtcggcaattatttaattaccgcggtctgctttaaccgtccctacttaaaaaagaaactgacgttaggttctgtcgtcacgatatcggggaaatgggataaacacagacagaccgtttccgtgcaggaattaaaaaacggtcctcatcaagaagataaaagcattgagcctgtttattccgttaaagaaaacgtcaccgtaaaaatgatgagacggtttattaaggaagcgctgcagcatcatttggacagtgcggccgatccgcttcctgaaaaattgagaatccgctacaagctgcctgattacaaacatgccctgcagacgatgcatcagcctgaaacgagggaatcgttacagcaggcaagacgccggtttgtttacgaggaattcttattatttcagctgaaaatgcaggcgttccgtaaagcggaaagggaacagtcaaaaggcatcagccatgtgtttcctgctgaaaagctcgctgctttcacagacagcctgccgttttcgctcacaaccgcacagacgcgcgtgcttcgggaaattatcgctgatatgacatccccttaccgaatgaaccgtctgctgcaaggtgatgtcggttcagggaaaacggccgtcgccgccatcgctttgtacgctgcgattctgtcggggtatcagggggcattaatggtgccgactgaaattctggccgaacagcatgcagattctctcgtatcgttgtttgcaaatgaagatgtaaatatcgcgcttttgacgagttctgtaaaaggaaagcggcgcagggagcttttggagcggcttgctctcggagagattgatattttagtagggacccatgctttaatccaggacgaagtggaatttaaagcgctgagccttgttattacggacgagcagcacaggttcggagtcgaacagcgcaaaaaactcaagaataaaggtcaggatccggatgtgctgtttatgacagccactccgattccgagaacgttggccattaccgtcttcggagaaatggatgtttccgtgatagatgaaatgcccgcggggcgaaaacaaatcgaaacgtattgggtgaaacacgacatgctggagcggattttggcttttatagaaaaagagctgaaacagggaaggcaagcctatattatctgcccgctcattgaagagtcggataaactggatgtgcagaatgcgattgacgtatataacatgctgtctgacgtttaccgcggtaaatggaatgtcggcctgatgcacgggaagctccattctgatgaaaaagatcaggtgatgagagaattcagcgccaatcaatgtcaggtacttgtgtcaacaaccgtcgtagaagtcggggtgaacgtgccgaatgcgacgattatggtcatctatgacgccgaccgtttcggattatctcagcttcatcagctccgcggccgggtcgggcggggagaccaccaatctttctgtatcttgatggccgatccgaaatccgaaaccgggaaggaacggatgagaatcatgtcagagacaaacgacggcttcgagctgtctgaaaaggaccttgaactgcgcggccccggggatttcttcggaaaaaaacagagcggtatgcccgagttcaaggtggcggatatggttcatgactacagagctttggagacggcccgccaggatgcggccaatctggtgtcttcagaggctttttggaaagatgacgaataccgcatgctgcgcggccaattactttcaagcggcgtcctagaaggggagaaattaagttgattctgtaaaattcggcggctttcaaaaaacaatcattgcattccaatctatgagattatatactactattagtacctagtcttaattgtccggatggtgtttacagatgagaagaagcaagaaagaacgccaaaaattattgcagcagacgatcaaatcgacacccttcatcacagatgaagaattagcggggaaattcggcgtcagcattcagacgatccgtttagaccgcttagagctctcaataccggagctgagggaaagaattaaaaacgtggcagaacaaacgcttgatgatgaagtgaaatcactgtctttagacgaagtgatcggtgaaattattgatctggagcttgacggccaggccatttccatattagaagtaagacgcgaacatgtcttcagccgcaatcaaattgcgcgggggcatcatttgtttgcgcaggcgaactcactcgccgtagccgtcattgatgatgagctggcgctgaccgcaagcgcaaatatccgctttacaagacaggtgaaagaaggcgagcgcgtcgttgcgaaagccaaagtgacggcagtcgaaaaagaaaaaggcagaacggtagttgaagtcaacagctatgtgggagaagaagtcgtgttctccggcagctttgacatgtaccgttcaaaacaatcataaaggtggagcatgcatgagaatagctgtagatgcaatgggaggcgacaacgcacccaaagctgttattgacggagtaatgaagagtattgaggcatttgacgatcttcatattacgctggtcggtgacaagacaacgatagaatcacacttgccaacaacatcagaccgcatcactgtgttgcacgccgatgaagtgattgaaccgacggatgaaccggtccgcgccgtacgcagaaagaaaaactcttctatggtgctgatggcgcaggaagtggctgaaaacagagcggacgcctgcatctcagcggggaatacaggcgcactcatgacagcgggactgtttatcgtcggcagaattaaaggaatcgaccggcctgcgcttgcgccgacgcttccgaccgtttcaggcgacggtttccttcttttggacgtgggagccaatgtcgatgccaaaccggagcatctcgtccagtacggaattatgggatctgtatatgcccggcaggttctcggaatcagctcgccccgcgtcggattgttaaatgtcggcacggaagaaaagaaaggaaacgacctgacaaaaaagacgtttgaattattaaaagaaacaaacgtgaattttgtcggaaacgttgaggcgagagacttgctcgaaggcgctgctgacgtcatcgtcacagacggctttacgggcaacgtcacgttgaaaacattggaaggttcagcgttatcgattttcaaaatgctgaaagatacactgacttcaagttttgttactaagctcgcagcgggagtgctgaagccgaagctgatggaaatgaaactgaaaatggactattctgagtacggcggggcgagtcttttcggtttgaaagcgcccgtcgttaaagcgcacggctcttctgacgcacgcgctgtttaccatgcgctgcgccaggcgagagaaatggtcagccaaaacgtggccgcatttatagaagaagaagtaaaagaagaaaaaacagatgagtagtctggaggttaccgcatcatgagtaagattgcatttttatttcccggacagggatcacaatatatcggtatgggaaaagacctgtacgaacgcgaagaagcgtcaaaacgtatttttgatgaagcggatgaaacgcttgaaacaaagctgagctcgctcatttttgaaggtgacgccgaagaattgacccttacatacaatgcgcagcctgcgctgttgacaacgagcatcgccgtattggaaaagtttaaagaatccggcatcacccctgatttcaccgccggccacagcctcggagaatattcggcgcttgttgcggcgggagcgatgacgtttaaagatgctgtttacacggtaagaaaacggggagaattcatgaatgaagccgtgccggccggagaaggcgccatggcagcgattctcggaatggatgcggagtccttgaaaaaggtaacggatcaagtgacggaaaacgggcatctcgtacagcttgcaaacctgaactgccccggccagatcgtaatttccggaacggcaaaaggcgtggagctggcttcagaagaagcgaaaaacaacggagcaaaacgggcaatcccattagaagtaagcggaccgttccattctgaattaatgaagccggcagcgcaaaaactcgaggaggtgctcagcgcctgtgagttaaaaaatgcggctgttcccgtgatttcaaacgtttcggctgacgttatgacagaaaaagacgatatcaagaaaaaattgatcgaacagctgtactcacctgtacgctttgaagaaaccattaacaaactgattgacgaaggtgtcacgacgtttgttgaaatcgggcccggaaaagtgctttcaggccttgtgaaaaaagtgaaccgccgccttaaaacaatcgcggtttctgaccatgaaaccatcgaactggcgattcaaacgctgaaggaggagaatcaggatgcttaatgaaaaaacagcagtggtaacgggagcgtcccgcggaatcgggcgggcgatcgcgcttgatcttgcgaaaaacggctgtaacgtagtagtcaactactccgggaatgaagcgaaagcgaacgaagtcgtagatgaaatcaaatctttgggccgaaacgcgatcgcggtaaaagccgatgtatcaaattccgaagaagtacaaaacatgatgaaagaggctgtcgctgcattttcttcaatcgacattctcgtgaacaatgcggggatcacaaaagacaatcttctgatgagaatgaaagaaaatgaatgggatgatgtcattaacattaacctgaaaggtgtattcaactgcacgaaagccgttacaagacagatgatgaaacagcgctccggccggattatcaacgtatcatcaatcgtcggcgtcagcggaaaccccggccaggcgaactatgtggcggcaaaagccggtgtaatcggcttaacgaagtcatcagccaaagagcttgcgagccgcaatattacggtcaatgccattgctccgggctttatttctacagatatgacggacaagctttctaaagaagtccaagatgaaatgctgaagcagattccgctcgcgcgtttcggtgatccttccgatatcagcagcgttgttacgttccttgcttctgaaggatcgcgttatatgacgggccaaacccttcatattgacggcggaatggtgatgtaaagatttgtttttaaaatttcatcctagtttctctagttttttaaaaacgaatcctctataatacttgaggggaggtgaattgctatggcagatacattagagcgtgtaacgaaaatcatcgtagaccgccttggcgttgatgaagctgacgtcaaacttgaagcttctttcaaggaagacttaggtgctgattccctagatgtagttgagcttgttatggaacttgaagacgagtttgatatggagatttctgacgaagatgctgaaaagattgcaacagtcggcgacgctgtgaactacatacaaaaccagcaataagctgatgctaaaagtcccgcctgacagcggggctttagccctttaatcgttcggttaccggcgtctgacgctgtacgcgctgccgattccgtttacggcggggagcgcggtgaacctgatgtgcctatggaggttactatgtcaaaacactcacattttaaagataaaaaaaagttctataaaaaaatagagcaatttaaagagttccaagaacggatttcggttcattttcaaaacgagaaacttttgtatcaagcatttacacattcatcttatgtgaatgagcatcggaaaaagccgtatgaagacaatgaaaggcttgaatttttaggtgacgctgttttggaactgacgatctcccaattcttatttgccaaatatccggccatgagtgaaggagatttgacgaagctgagagccgctatcgtatgcgagccgtcactcgtctcacttgcccatgaattgtcattcggcgatcttgttctcttgggaaaaggagaagaaatgacgggcggcagaaagcgtcctgcgcttttagcggatgtgtttgaagcgtttatcggcgcactgtatctggatcagggccttgagccggttcagcaattcctgaaagtgtacgtgttccctaaaataaacgatggtgctttttctcatgtgatggatttcaaaagccagcttcaagaatttgtacagcgggacggaaaaggatcgcttgagtacaaaattctcaatgaaaaagggcctgcccacaaccgggaattcgaggcgcttgtctctcttaaaggtgaggcgctcggtatcgggaacggacgttccaaaaaagaagccgagcagcatgcggcacaggaagctcttgcaaaaatgcaaaaacatcatacgaaacaataaaatccccctgtttccctagggggatttcagtatgtctgcgcctgatataagcgggtgattatgataatattgagatacttatacgataaggaggatctgggatgttcctcaaacgtttagacgttataggatttaaatcatttgcagaacggatatccgttgactttgtaaaaggcgtcacggccgttgtcggtccgaacggcagcggaaagagcaacattaccgaagccatccgctgggtgctcggcgaacaatcagcccgctcgcttcggggcggaaaaatggaagatatcatttttgctggaagtgattcgcgcaagcggctgaaccttgccgaagttacgttaacgcttgataatgaagatcattttctcccgatcgattatcacgaagtcagcgtgacgagacgggtgtaccgctccggagaaagtgaatttctcatcaacaatcagcagtgccgcctgaaagacatcattgacttatttatggactccgggctcgggaaagaagcattctctattatcagccaggggaaagtcgaagagattctcagcagcaaagcggaagaccgccgcagtatttttgaagaagcggccggcgtgctgaaatataaaacaagaaagaaaaaagcggaaaacaaactgtttgagacgcaggataacttaaacagggtggaagatattctccacgagcttgaagatcaggtcgaaccgctgaaaatccaggcatcaatcgccaaagactacttagaaaaaaagaaagagcttgaacatgtcgaaatcgcccttaccgcctttgacatcgaagaactgcatggcagatggtcgggtttaaaagaaaaggtgcaggcggcaaaagaagaagaattggcggaatcatcggctctgtccgcaaaagaagcgatgatagaagagacgagagataaaatccacgcgcttgatgaatccgtcaacgaactgcagcaggttctgctcgtgacaagtgaagagctggaaaagctggaaggccggaaagaagtgctgaaagagcgcaaaaaaaacgccgcgcaaaaccgggaacagcttgaggaatccgttacacattacacgaacaaagaagccgaactgaaagcggacattgaaaaacagtctgccgtctatgataaacttcgtgcggaagtgaagcggttaaacgcccaggtgaaagaaaagcagcaggctctcagtctgcataatgaaaatgtagaagacaaaatcgaacaattaaaaagcgattactttgaattgttaaacagtcaggcgtcgattcgcaacgagctgcagcttttagatgaccagatgtcccaatctgcggtccagcaggcgagactgacagcaaacaatgaaaaataccttgaagaacgtaacgatattgcagtccgcaaagtggcgtgcgaagaagaattggccgccgttgaagaggatattcacaatcaggtcgtccgctttcgtgaagtccagacagcatatgaacagaaaaaacgccaatatgaaaagaaagaatctgcgctgtatcaggcatatcaattcgtccagcaggccagatccaaaaaagatatgcttgaaacgatgcaaggcgatttttcaggattttaccaaggcgtaaaagaagtgctgaaacagaaagagcagcttggcggcatccgcggcgccgttctcgaactgattgccaccgaacaaaaatatgaaacggcgatcgagattgcactcggcgcagcggcgcagcacgttgtcacagacgatgagcaggcggcgcggaaagcgattcaatatttaaaacagaattccttcggccgcgcgacgttcctgccgcttacggttatgaaaccgcgccagctccaaacccgtgatgaacagacggctcagaagcatccgtctttcctcggcacagcgagcgggcttgtcacatatgatgcggcatatcggaatgttattcaaaaccttctcggcaccgtgctgatcactgaagatttaaaaggcgcgaatgaactggccaagcttctcgggcaccgctaccgcatcgtgacgcttgagggcgatgtcgtcaatccaggcggatcaatgacaggcggcgcggtcaaaaagaaaaacaattctctgctcggcagaagccgtgagcttgagacggtgactgcgcggcttgccgaaatggaagaaaaaacagctctgctcgaaaaagaggtcaaaacgctgaagcaggccattcaagagcttgaacatacgctgagcggtctccgtgaagacggtgaagctttcagaacaaagcagcaggatgtaaaaggcaggctgtatgaacttgaagtcgctgaaaagaacatcaatacccatctggagctttacgatcaggagaaagcatcactgacggaaagcagccgggaaaaagagacgcgcaaatcagctctggaagaacagctgagtgaggcatccggccagctgaaagagcttgaggaagagatggaaaggctgacaaaacaaaagcagaccctatcctcaacaaaagaaacgctctctcatgaactgacggaatgtaaagtggccgctgcgaaaaaagaacaggcgtgctcgagtgaagaagacaacctcaaaaggctgaaaaaagagcttgaggaaacgcagctcgctctgaaagaaacacgggaagatttaagcctcctgacctcagaaatgacgtccagcacaagcggtgaggagcagcttgaagaagcagcccatcataagcttcacgataaaacgagaacaatcgaattgatcgccagccggcgcgaccagcgtgtgaagcttcagagggcgcttgatacgaacgaacttgagctgaaagagatgaagcgtctctacaagcaaaaaacagaaattctgaaagatgaagaggtaaaactcggccggatggaagttgagcttgataatctcttgcagtatttacgcgaggaatacagcttatcctttgaaggggctaaagaacaatatcagcttgaaatcgagcctgaagaggcgagaaaacgggtcaaactgatcaagctctcaattgaagagctcggaacggtcaatctcggcagcatcgatgaatttgaaagagtaaacgaacggtaccagtttttaacagagcagaaaaatgacctgacggaagcgaaaaacacactgtttcaagtcattgaagaaatggattctgaaatgacgaagcgtttccatgaaacgtttatccagatccgttctcaattcaacgacgtgttccgttctttattcggaggagggcgggctgaactgaagctgactgatccgaatgatcttcttaactccggggtggacattatcgcgcagcctccgggcaaaaaactgcaaaacttaaatcttttgtcagggggagaacgggcgctgactgccattgcccttttattctccattctgaaagtaaggcccgtgccgttttgcgtccttgatgaagtggaagctgcgcttgatgaagccaatgtattcaggtttgcgcaatatttaaaaaaatacagcagcgacagccagtttatcgtcatcacccacagaaaaggcaccatggaagaagcggatgtcctctacggtgtaacgatgcaggaatccggcgtttcccgaatggtttcggtcaaactggaagaaacaaaagaattcgttcagtaacgaggaaagaggttgaaagatgagcttttttaaaaaattaaaagagaaaatcacgaaacagacagactccgtctctgaaaaatttaaagatggtcttgaaaaaacaagaaattccttctcgaataaagtgaacgaactcgtctcccgctaccggaaagtcgacgaggatttcttcgaggagcttgaggaagtgctgattggcgctgacgtcggttttacaaccgtcatggagctgattgatgagctcaaaaaagaagtgaagctgaaaaacatccaggatcctcaggaagtgcagtccgtcatttctgaaaagcttgtcgacatttataacagcggcgacgaacagatttctgaattaaatattcaggacgggcgcctgaacgttattctgcttgtcggggtaaacggcgtcggaaaaacgacaacgatcggaaaacttgcccataagctgaagaatgaaggcaaatccgttgtgctcgctgccggagacaccttcagagccggggcgattgaacagcttgaagtgtggggggagcgtacaggcgtgcctgtcattaagcaggctgccggaagcgaccctgcggcggttatttatgatgccgtacacgcggctaaagcaagaggagcggatgtgctgatttgtgatacggccggccgccttcagaataaagtaaacttaatgaaagagcttgaaaaagtcaaacgcgtcatcgaacgcgaagtgcctgaggctccgcatgaggttctccttgcgctggacgcgacgacaggccagaatgcgatggcgcaggcgaaagaattctccaaagcgacgaatgtgacgggtatcgcgttaacgaagcttgacggcaccgcaaaaggcggtatcgtcctggcgatccgcaatgagcttcacatccccgtgaaactggtcggcctcggagaaaaggttgacgatctccagcgatttgatgcagaatcttacgtatacggtctcttttctgatttagttgaaaaagccgaggattaatgaataaaaaacgagtataaaatggacggttttatactcgtttttttatacgcattgatagatcggaatggagggggcaattgttggacaaatggctgaaagctgaattggaaagtaagatcggcgcgataaaccatatgtcgctgttgggtgaacagggaggcacttcaaccgttcgaaaaatagtgaccggtcaagacgcatttctgctgaaaagttcttttcaacagaagtatcgggaatggttaatgagagaagccttcgttttacaaaaactgacggaaactcgtcgtctgcctgttcctgtttattatgggatgatacaggaacagcatgccagccatatcatcatgtcatttgaggatggaatcaccctgacttcggctttaagaaaagcaaaaggggatactgaaaagaaaaagctgatcaaaagtttcggccggtttctgcaacggctgcatgaaaccgaaatggtctctggtttacagccggaaacagactggctcgatctgcaaatcaaacgagccggggaatatgtcaaaaaaaggcaggctgaaggaagtgcagagcttttgaaggaattggacaggtacaggcctgttcctgttcagcagacaatgattcacggtgactgcacgactgataatgtgctggtgaaagacggagaggtctatctgtttatcgatgctgcgggaatatcggcgggagatccgcgatatgatgaatcattagcgatcagtcattttgtcacaaatgaagcatacctcaatgctttttacgaaggctattgccgctaccgtgtatcaaaacaagaattcgagtattttaacgacggtctatatgaatttttttgaaaaaacttatgatgtaaaaagagcatcatgctttgacaagataaaaacttgacacacgctctgaaaccatgtaaactaagtttttgtaaagggatttgacttaacaaaggggagagctcaaatgtcgctcgaaaaaacgacgagaatgaactatttatttgacttctatcagtcgttgctgacgtcaaaacaaaagagctatatgtcgctttattatctggacgatttctcccttggtgaaatagccgaagagtatgacgtttcaaggcaagccgtttacgataacatcaaacggactgaagcgatgcttgaacaatatgaagaaaaactgctcctttttaaaaagtttcaggagcgtaaagaaatgtttacaaagctgaaagagcttgcttccgggttgcaggaagaggaaaaaatgacggctctgattgaagcgcttgagaaattagattaggaggcggcaaacaatggcatttgaaggattagccgaccgactgcaaaagacgatttcaaaaatccgcggaaaaggaaaagtcagcgaacaagacgtaaaagagatgatgcgtgaagttcgtcttgcgcttcttgaggctgacgttaactttaaagtcgtaaaggattttgtgaaaaaagtaagtgaacgggctgtcggacaggacgtcatgcagagtctgacacccggtcagcaggttattaaagtcgtaaaagaagagcttaccgagctgatgggcggcgaagaaagcaaaattgccgtcgccaaacgcccgccgaccgttattatgatggtcgggctccaaggtgccggtaaaacgacaaccacggggaagcttgccaacctgctgcgcaaaaaacataaccgcaaaccgctgctcgtggctgcggatatttatcgccccgccgcgattaaacagctggaaaccctggggaaacagcttgatatgccggtcttttcgcttggcgatcaggtcagcccggtggaaattgccagacaggcgattgaaaaagcgaaggaagagcatcatgattatgtgattttagataccgccggacgactgcatatcgatcatgaactgatggatgagctctccggcgtaaaggaagtcgcaaatcctgaggaaattttccttgtcgtcgactcaatgaccggtcaggatgcggtaaacgtcgccaaaagctttaatgaccagctcggtttaacgggtgtcattttaacaaagcttgacggggatacccgcggaggtgcggcgctttctatccgcgcggtcaccgaaacgccgattaaattcgccggaatgggagaaaagctcgatgctcttgaagcgttccatcctgaacggatggcatcccggattctcggaatgggtgacgtgctgacgctgattgaaaaagctcaggcgaccgttgatgaagacaaagccaaagagcttgagcagaaaatgagaacgatgagcttcacattggatgattttctggagcagctcggccaggtccgaaacatggggcctcttgacgaactgctgcaaatgatgcccggcgcaggcaaaatgaaaggcttaaaaaacatccaagtcgatgaaaaacagctgaatcatgtggaagcgatcattaaatcaatgactgttcttgaaaaagaacagccggatatcattaacgccagccggcggaagcggattgccaaaggaagcggaacatccgttcaggaagtcaaccgtcttttaaagcagtttgaggaaatgaaaaaaatgatgaagcagatgaccaacatgacaaaagggaagaaaaaaggctttaaattaccttttatgtaatcggttatacatgataaaaccgttgttaagaaaaaacactttacaaacacttttatcattgttaatatactatcttgttgaaatattttcggaggtgctagtaaaatggcagtaaaaattcgtttaaaacgtatgggagcaaaaaaatctcctttctatcgtattgttgtagcagattctcgttcaccgcgtgacggccgtttcatcgaaacagtcggcacatacaacccggttgcaaagccggctgaagtgaaaatcaacgaagagcttgctcttaaatggcttcaaacaggagctaaaccttctgatacagtccgcaacttgttctcaagccaaggaattatggaaaaattccacaacgctaaacaaggcaagtaatgactgatcagaacttggaagatttgattgtcagcattgtggctccgcttgtcgaccatccggaagacataacggtcacaaaggaagagactgatcaaaagattgcgctgcgcttatctgtcaataagtcagataccggtaagattatcggaaagcaaggccggactgcaagagcgattcgaaccgtcgtttttgcagctggcgcacagtcttctaagaaagttcaatttgaaatatttgactgaaaaagggagagggccggcacctcccctttttttacacgtaaaaaaggcaaatgaacagaaatatgttggaagagtggggagtctggtcctatgcagattattcacagggtaaccgttatgcaggttctgaccgagcaaagtaaggaaaagcttttggcctcttttgtagaaaaaaagcaaacgcttgaacgagaatgcagccagctctattttcagcttagaaaacatgaaaaagatcagcagaatcccgatgtagcggaatcttttaaaaaagccattgaaaaaagacaagacaaaatcaaaatgatcgatttccaaataagccagacagagtcgctcccgcttggaagcgaagtgaaggaaaaggagatcgatgcgctgctttcaatcaacgtcggtgataactggcatgaaaaaacagcggcaaataccatcgtcataaaagacggggtagtaattgaaatccgcccgaggtgataatatgacaaacagatggtttaatgtaggcaaaattgtaaatacccacggcattaaaggcgaagtgcgggtcatttctaaaacggactttgccgaagaacggtacaagcccggcaatacgctttatttgtttgcggaaggggctgcggagcctgtcaaagtaacggtcagcgcccacaggcttcacaagcagtttcacctgctgcaattcaaagaaatgccgagtctcaatgaagtcgagcacctgagaaacatggtgatcaaagtccctgaagaagacttgggagagcttgaagaagatgaattttattttcatgaaatcatcggctgcgaggttgtgtcagaagacggggaactgatcggcacagtgaaggaaatcctgacgcccggggctaatgacgtatgggtggttgcaagaaaaggcaaaaaagatgcgctcattccgtatattgcttctgtggtaaaggatattaatataaatgagaagaaaattaagattcatgtaatggaagggttaatagacgaatgaaaatcgactttttaacactgtttcccgaaatgtttcaaggggtgctcggctcatccattctgcaaaaagcacaggaaaaagaggctgtccgttttgacgtcatcaatttccgggctttttcggataataaacaccaaacggttgatgattacccgtacggcgggggagccgggatggtgttaaagccgcagcccgtatttgatgcggttgaaaagctgacagccggtacggacgccaagccgcgcattattctcgtctgcccgcaaggtgagcgttatacgcagaagaaagccgaggagctggcggaagaggaacatctcatgtttatttgcggacattatgaagggtatgatgaacggatccgggaacatcttgtcactgatgaaatctccatcggggattttgtgctgaccgggggagagctccctgccatgatgatcgccgacagcgttgtcaggcttttgccgggcgttctcggaaaagaagcatcccacgtggaggattccttcagcacggggcttttagagcatccgcactatacgaggcctgcagattatagaggcttaaaagtgcctgagacccttctgtcgggcaaccatgccaaaatacaagaatggcgcaataaagaatcaatcagaagaacctttttaagacgtccggatcttcttgaaaactatcctctcactgatgagcaaagaaaatggatttccgagtgggaaaacgaatagattctattgcgcaggcgatgaaggtatgataagatactacttgtggcttaaggaggcttatccttcagaagcttgaaaacgatgttccgctgtgccttgcagttgtggccaagagcatctgttggaaggagttgaaaacgatgcaaaaactaattcaagatatcacaaaagaacagcttcgcactgatcttcctgcgttccgtcctggtgacactttacgtgtacacgtaaaagttgttgagggtaaccgtgagcgtatccagatcttcgaaggtgttgtgatcaagcgtcgtggtggtggaatcagcgaaacgttcacagttcgtaagatttcttacggtgttggcgttgaacgtacattccctgtacacacaccaaaaatcgcgaaaatcgaagttgtacgttacggtaaagtacgtcgcgctaagctttactacctgcgtgaacttcgcggaaaagcggctcgtattaaagaaatcagacgataatgataacgaacgaaaagagcttgttacccgtaacaggctctttttttatatgaaatttgtaaaagcggaacaagcaacgtaaaatacataagagatcatcggaacatccggttccggtaaataaggcaggtgtcgaagtcacatgaccattcaatggttcccgggccatatggctaaagcgagacgggaagtaacagaaaaactgaaattaattgatatcgtatacgaattggtggatgcgagaatcccgatgtcatcgagaaatccgatgattgaggagattttaaaaaataagccgcgcattatgcttttaaataaagccgataaggcggatgcggctgtgactgcccagtggaaggaccactttcaggaacagggcattccctctctttcaataaactccgttaacgggcagggactgcatcaaatcgtgccgtcctcgaaagagctgctgaaggataagttcgataaaatgaaagcaaaaggcattaggccgagagcaatccgcgcattaatcatcggcattccgaatgtcggcaagtctacgctcattaaccggctggccaaaaaaaacattgccaagacgggagacaggcccggcattaccacttcacagcagtgggtaaaggtaggcaaggaattagagctgctcgatacaccgggaattttatggcctaagtttgaagatgagcttgtcggcttgcgcctggcgatcaccggggcgattaaagatacgattatcaacctgcaggatgtggctgttttcgggctgcgctttctggaagagcattatcccgaccgtttgaaggagcgctacggacttcaggaaatccctgaggatatcgccgctcttttcgacgcgatcggtgaaaaacgcggctgtttgatgggcggcggaatggttgactatgataaaacaacggaagtcatcattcgggacatccggacggaaaaattcggcaggctttcatttgaaacaccatcagaataaagacgcgcagcgatgcgggtctttattttttccgcagaataccgatatacataatgtaagggagaagagaacgtgaatacattaaccgtaaaaagcgtaaaagaacgcctgcaagaggtcagggacgaaagcgaccccttccttgcccaatgtgagaaagacccgagaaaaagcgtacagacgcttttagagcaatggctgaaaaagcacgcgaaggaaaaagctcttaaagagcaatggctgaacatgacggcatacgaaagacagtcatccaaaaagggcttccgcctgattgcgggtgttgacgaagccggaagagggccgcttgccggaccggttgtcgccggcgccgtcattttgccggcagaatgcgagattctcggtctcacggactcgaagaaattgtcggaaaagaagctcggggagtattacagccggatcacggaagaagcggcggctgtaggagtcggcattgtccatgcggacgttattgaccggatcaacatttatgaggccgcgagactggcgatggtaaaagccgtcaatgctttaacggaaacacctgattatctgcttgttgatgccatgacccttccgcttgacattccgcagtcatcagttataaaaggggatgccaaaagcgtgtcaattgccgccggagcctgcatagcaaaagtaacgcgggaccgtctcatggctgagtacgccaaaacctaccccatgtacggctttgaaaaaaataaaggctacggaacgaaagaacatcttgaagctcttcaggcatacggaccgacaactattcaccgaaaaacgttcgctcccgttcaatcttattgttagaaaagaggcttaagacatgaacattagcggcgaaatccaagcggctttcagacagctgacggcggaaatccctccggaccggcaggacggcggtaaagacagcggcgctcaaaggctgctgttagggaaggttctccgtttgctggacgatcaaagcgctcttatccagatcggcggccggacgatgcagggaaagcttgaaaccgccctccgaccgcaggcgtattactggttttcttatgacaaacagccggcggaaaaaacgggccggcttcatgtcatcgaccaattcgaaggaagcccgaaaaccgttcaggaagcagcgggtagactgttaaacgctctttccgtcaaaccgggccctgtgtctctgcagattgccgaaacgtttatgcagcagaagctgccgatgacggaaaacagcctcaaagcctgcatccgctgggctgaatcgcttccggccgccgaattgaaaaaagcggcggaaacaatcgtatttgcgctgaaacgggaactgcccgcacatccggaagtcttgtcagccattcatgccgttaaatatccggttccgacccgtcgcctcctctcaggactgcttcaggcaatcaatcaggctccgcaatcggcaaaagagctgtctgtgctcaaagaggcggtttctgacgtattaaacgcggaaacggatcttcatgcagaacgtctcttgaagaagcttgccgaggctgcacgcatgccgatcccagaaaccgggctgatggatgaagaagaacggacggaatccaaacaatcaccatttgtccgagagactcgtgaaaacggaaaggcagtctcaagccaaccttctcctccgagtgcgcggacagatccggaacttcctgaaaaaacggcaaaacagattatagagaaattaatgacatcggcagaaaaaactgaaaaccgccccgtaaaagtaacggcggagatcattaaggctttcatttctcaagaaaaaacatttaaaacagcacctgttcttcaaaaagcacatctgacagaacaggaggcggctgttttcgaaaaagccgttcagctcaccgaattgaaatatgcggaaaaacatgatgtattaagccttttgcagaaaatcaaaaaaggattgggcacgcgtgatgaattatcattcattacagcgcttgaaaaaggcgtatctcttcagccggagaaacaagcgctgaaaaccgccctccaagctgtccggacgcttcaagaagcgccccaatccgttaaacaagaggcggaaccgcttattcataaattaaacggccagctgtttattgagcagcataacccttcttttacgcagatggtgctgtcatttccgctgggagcgtccgcgtatgagaatgacatcacagttctctttaaaggacggaagaagccggacggaaaactcgatccgtcacattgcaggctcctgtttttgctgcatcttgaaacactgcaagaaaccgttgtggactgcatcattcagcaaaatgtaatgactattacggttgagactgattttgagcttcaggcggccatcgaccctctcgtaccggctttaaaagaagccgtaaaagaaacgggcttcagcctgtcaggcgtcacggctaaaaaacggcgcccgaaagaccagagcgctcttgtggaagagtttatagaaaaagacggcggaagaaaagtggatgtgaaaatatgaaagagcaaacgccgttaagaagagctgtcgccctgcattacgaccggcagaaagaccaagtcccgaaggttgtcgcaacaggcagggggcacgtggcggaaaatattataaaagaagctgagaaggctggggtccccattcaggaagacagaacccttgtcgaattaatgcgccatttgacggttgacgatcagataccggaggcgctttatgaaaccgttgccgaaattttttcatttgtttacagactggacgaaaccctgaaaaacgaaaaataaggaccattcatttcccggactccgtttaaatttatattttcaataaaataaaagttagaatgtttggaaggatataaagattttgttttgaaccctagacaattcttccagtattatatagaatgaaagcgcagtctatttttagttttgctacataagttaggaggatgggaaatgaatatccatgagtaccagggaaaagaagtcctcagaaaatacggggtgtctgttcctgaaggtaaagtggcttttacagcagaggaagcagttgaaaaagcagagagcctgtcaagctcggtttatgtcgtaaaggcgcaaatccatgctggcggccgcggcaaagctggtggggtaaagattgcaaaaacaaaagatgaagtgaaagagtatgccgaagaactgttaggcaagacgctcgtcacacatcaaacgggtccggacggacaagtaataaaacgcttacttattgaagaaggctgcgatattaaaaaggaatactatgtcgggcttgtacttgaccgcgctacttcaagaatcgttttaatggcgtctgaagaaggcggaacggagattgaagaagtagcggaaaaaacacctgaaaaaattaaaaaagcggtaattgatccggctgtcggccttcagggctatcaggcaagggaaattgcattcgcaattaacatcccgaaagagcttgtcggcaaagccgctaaatttatgctcggtttatacaaagcatttgttgagaaggactgctccatcgccgagatcaaccctctcgtcgttacgggggacggaaacgtcatggcgctggatgctaagctgaacttcgacagcaatgcgttatacagacaaaaagacattatggaatacagagatttagatgaagaagatccgaaagaaatcgaagcgtcaaaatacgatttaagctacatttcccttgatggaaatatcggctgtatggtaaacggcgcgggtcttgcaatgtctacaatggatatcattaaacactacggcggagaacctgcaaacttccttgatgtcgggggcggcgcaaccgcagaaaaagttacggaagcttttaaaatcattctttccgatcaaaacgtaaaaggaattttcgttaatattttcggaggcatcatgaagtgtgatgtcatcgccgagggcgttgttgaagcgacgagacaagtcggattgacattgccgctggtcgtgcgccttgaagggacaaacgtagatttaggaaagaaaatcctgaatgaatcaggcttaaacatcacatctgcggaatcaatggcagacggcgcacagaaaatcgtatccttagtttaggaaagaatgaaaggcaggggaccagataatgagtgtttttatcaataaagatacaagagttattgtacaggggattacaggttctaccgctttatttcatacaaagcagatgctggaatacggcacgaatatcgttggcggtgtaacacctggaaaaggcggaacggaagcggaaggcgtaccggtattcaatacggtcgcagaagcggttcatacaacgggcgctgatgcgtcagttatttacgtgccggctccgtttgcggcggacgcaattatggaagcggttgacgcggaaattgatcttgtcatttgtatcactgagcacattccggttttggacatggtgaaggtgaagcgctttatggaaggcaagaaaacgagattaatagggccgaactgcccgggtgttattacacctgaagaatgcaagatcggcattatgccgggatacattcataaaaggggccatgtaggcgttgtatcccgttcaggaacattgacatacgaggccgtccatcagctttcagaagccggcgtaggccaatctaccgctgtagggatcggcggcgatccggtcaacggcacgaactttattgacgtgttaaaagcgttcaatgaagatcctgaaacacatgccgtcatcatgatcggagaaatcggcggcacagctgaagaagaagcggctgagtgggtgaaagcgaacatgacgaagcctgttgtcggctttatcggcggtaaaaccgcgcctccgggaaaacgcatgggccacgcgggcgccatcatctccggaggaaaaggcacggcagaagaaaaagtcaaaacgatgaacgcctgcggaattgaagtcgcggaaaccccttctgtaatgggtgaaacgttgattaaggtgttaaaagaaaaaggcttatttgaaacgtgcaaaacgcactgatcgaagcaggggcagccgtaacggctgttcctgtttttgctgaaaaaagaggaggttgccagatttggatcaagcatcgcgctgtttaatggtctgcagtattaatcaaatcatttccccgtctcttctattaaaatggtggaaagctgatcactctctgtcttttttaccggatccgcatccattaactgctttatcagaagggaaaacagtgcccgaagcaatttttcgggaaatagagcgcaaggatccggaacttgatgaagttctgtccgattaccgccgcaaaggcattactgtcattccgatttcatcaacccgctatccaacatggcttaaagcgatttatgatccgccggctgtcttgtatgcaaaagggaacacgccgcttcttgaaaaagggagaaaactcgggattgtaggaacgcggaaaccgacagaagacggaataaaagcggctgggcatctttccgccgaactctcaaaaaaaggctgggtcattgtaagcgggcttgcatccggtatagacggattgtctcataaggcgagcatcagggcaaaagggcttacgatcggcgtgatagccggcggattccatcacatctatccccgggaaaatctcctgttagcagaatacatggctgaacaccatctcctactctcagaacatcctcctgaaacaaagccgaaaaaatggcattttccgatgagaaaccgcataatcagcggactaagtgaaggaattgtggtcgtgcagggaaaagaaaaaagcggttcattaatcacagcttaccaggccctcgatcaaggcagagaggtatttgccgttccgggttccatatttaatccatattccggaggacctataaaactcattcaagaaggggcgaaagctgtattatgcgcagaggatattgacggagagctgaccgcccgatgcgttcagtatacggaacccttttgaaatatcgtttgacaaacggtattgtaatatttaataatagtgaggatttaaagttgcatattattttcatgtataaaatgacgttcatcataaagaatgaaatgttgaaagccataaaaaggcagctctaaaatgaattgatacttgaaaagagagagaacacctcttgagggggatgaaaatgtctgattatctagtcatcgtggaatcgccggcaaaggcgaaaacgattgaacgttatttagggaagaaatataaagtcaaagcttcaatgggacatgtccgggatcttccgaaaagtcaaatgggagttgacatcgaacagaactttgaaccgaaatatattacgatccgcggaaaaggccctgttttaaaagaattaaaaacagcggcaaagaaagcaaaaaaagtctatctcgcggccgaccccgacagagaaggggaagcgattgcatggcatctcgcacacagtcttgatctggatctcagctcggactgccgggtcgtctttaatgaaataacgaaagacgccattaaagaatcatttaaacatccgcgcatgattaacatggatcttgtcgatgcgcagcaggcgcgccgcatactagacagactcgtcggatacaaaatcagcccgattctttggaaaaaagtaaaaaaaggcctcagtgcgggccgtgtgcaatccgttgcgctccggctgatcatcgaccgggaaaaggaaatcaatgactttaaacctgaagagtactggacgattaccggctcatttttaaagggaaaagagacgtttgaagccggatttttcgggaaaaacggcaaaaagcttcctttaaaaagcgaagaagacgtaaaagccgtccttgctcagctgaaaggcaataagtatacagttgacaaggtgacgaaaaaagagcgcaaacgaaatcccgctctgccgtttacaacgtccactctgcagcaggaggctgccaggaagctgaatttcagagcgaagaaaacgatgatgatcgctcagcaattatatgaaggaattgatctcggcaaagaagggacagtcggactcatcacatatatgagaacggactcaacgcggatttccaatacagccgttgaagaggcgtcagcttttattgatcaggcatacggaaaagagtacttagcgggaaaacggaaaccggcaaagaaaaatgaaaacgctcaagatgcccacgaagcgatccgcccgacttcagtgctcagaaaaccagccgacttaaaagcggtgcttggaagagaccagctcagactatacaagctgatttgggagcgctttgttgcaagccagatggcgcctgccgtccttgatacgatgagcgtcgatctcagcaataacggattgacattccgggcaaacggaagtaaagtcaaattcgccggcttcatgaaagtctatgtagagggtaaagacgatcagctggaagaaaaagaccgcatgcttccggaccttaaagagggagacacggttttatcaaaagatattgagcctgagcagcactttactcagccgcctccgcgttatacagaggcgcgcctggttaaaacgcttgaagaactggggatcggccgtccttcgacatatgcgccgactcttgacaccatccagcgccgcggttacgtgggattagacaataaacggtttgtgccgactgagcttgggcagatcgtgctggatcttatcatggagtttttcccggaaatcatcaacgttgaattcacggctaaaatggaaagagaccttgaccatgttgaagatggccagacagaatgggttcaaatcattgacagcttctataccgatttcgaaaaacgcgtgaaaaaagcggaagctgaaatgaaagaagtggaaattgaacctgaatacgcagatgaagattgtgaattatgcggctcccggatggtttataaaatgggccgatacggtaaatttatggcgtgttccaacttccctgactgccggaatacaaaaccgattgtcaaacaaatcggcgtaaaatgtccgaagtgccatgaaggaaacattgtcgaacgaaaatcaaaaaagaaacgcgtcttttacggctgtgaccgttatcctgaatgcgacttcgtatcttgggacaaaccgattgaacgaaaatgcccgaaatgtgaaaatatgctcgtagagaaaaagcttaaaaaaggcatacaagtccaatgcgtcgaatgcgattataaggaagaaccacagaagtagcggtgagcagagccttgctcaccttctttgtgtggaagggacaaacaacaggagatgaaaagaaatgaaccagcaaacagttaatgtaatcggagcaggccttgccggaagtgaagcggcatggcagcttgcaaaacgaggaattcaagtaaaactatacgaaatgcggcccgtcaggcagacggcagcccatcatactgataaattcgctgaactggtatgcagcaactccctccgttcaaatacactcgccaatgcggtaggcgtattaaaagaagaaatgcgggcgcttgactcggcaatcattcaatctgctgataaatgctcggttccggcagggggagcgcttgccgttgaccgccatgaatttgcgcaaagcgtgacggatctcgtgaaaaaccatccgaacgtaacggttcttactgaggaagtaacagagattccggaaggcccgacggttatcgcgaccggaccgcttacgtcagaatcgctttcacagcagctgaaagagctcacgggagaagagtatctgtatttttatgacgcggcggcgccgattgtcgaaaaagacagccttgatatggagaaagtgtacttaaaatcccgttatgacaagggagaagcggcgtacttaaactgcccgatgacagaggaagagttcgaccgtttctatgaagcattgacgacggctgagacggtacctttaaaagaattcgaaaaagaaatcttctttgaaggctgcatgccgattgaagtcatggcgaaaagaggcaagaaaacaatgctgttcggaccgatgaaaccggtcggactggaagatccgaaaacaggcaagcgcccttatgcagtcgttcagctcagacaggatgacgcggcgggtacgctttataatattgtaggttttcagacacatttaaaatggggagaccaaaaagaagtgcttaaactgatccccggccttgaaaatgttgatatcgtcagatacggcgtcatgcacagaaacacatttatcaactcgccgagccttttgaacccgacatatcaatttaaacagcggaacgatctgtttttcgcgggccaaatgaccggtgtagagggttatgttgaatctgccgcttcaggtcttgtagcgggaatcaatgccgccaaacttgtgctcggtcaggatcttgtgacattcccgcaggagacggcgatcggaagcatggctcactacattacgacgacaaatcagaagaacttccagccgatgaatgcaaacttcggcctcttaaaagaattgcctgtaaaaattaaaaacaaaaaagaacgaaatgaagaatacgctaaacgcgcaattgagactattcaaactatttcgaaaacgatatagcttttcattgcaacttcgatgcattatatgataccatttaaaagcccttcggagagggaggtcttcataatgactgagaatgttaacttttttttaaagttattcgttgaatatttacaaattgaaaaaaattattcacaatatactattgtgaattatgttaattcgattgaagaatttgggatgtttctgcatgctcaaaatataaatggaatgaaagaagctgcatatcatgatgtgagaatatttttgacagaggcttatgaaaaaggcctgtcaagaaaaacaatcagcaagaaaatttcagctttgagaagcttctataaatttttaatgagggaaaagcttgttgaagagaatccgtttcagcttgttcatctgccgaaacaagagaaacggattccgaagtttctttatgaaaaagaacttgaggaactattcgctgtttcagacagaagtcagccgtcagggatgcgcgatcaggccctgcttgagcttctttatgcgaccggaatgagggtcagtgagtgctgtacgcttactgtcggcgatcttgacctgttcatggatacggtgctcgttcacgggaaaggcaagaagcagcgctatatcccgttcggctcatatgcccgtgatgcgctggagctgtatatcaacagcggaaggcagtgcctgcttgaaaaagcaaaagagcctcatgatgtgctgtttgtcaatcaaagaggcggcccgctgaccgccagaggaatccggtatattttaagcgggcttgtaaaaaaagcatccggcactttacatatacacccgcatatgcttcggcacacgtttgcgactcatctgctgaatgaaggggctgatttaagaagcgtccaggagcttttgggccattccaatctgtcttctacgcagatatacacgcatgtatcgaaggaaatgctgagaaacacatatatgtcccaccacccgagagcttttaaagaaaattaaaaggaggcccttctcatgtcatcttttcatgcgacaacgatttttgccgtccagcataacgggaaaagcgctatgtcaggagacggccaggtcacattcggtcaggctgtagtcatgaaacataccgcgagaaaagtgagaaagctgtttaacggaaaggttctggccggatttgcgggatctgttgcagacgctttcacactttttgaaatgtttgaggcgaagcttgaagaatacaacggcaatttaaaacgtgcgtcggttgagcttgcgaaagaatggcgcagcgataaagtgctgcgcaagctggaagccatgctgattgtcatgaaccaggataccttgcttctcgtatcgggaacaggtgaagtgattgagccggatgacggtattttggccatcggctccggcggaaactacgccctgtcagcaggaagagcgctgaaaacctatgccggagagaatctgtccgccaaagatattgcaaaagccgctttgaaaatcgcgggcgagatttgtgtgtacacaaacgatcagatcattttggaagaacttgaatagaaaggacttgaggcgcatggaaaacaaaccgttaacaccgagacaaatcgtagatcggttggatcaatacattgtaggacagcaggatgcgaaaaaagctgtcgccgtggcattaagaaaccgctatcgcagaagtcttcttgatgaaaaactgagagacgagatcgttcccaaaaacatcctgatgatgggcccgaccggggtggggaaaacagagatcgccagacggatcgccaagcttaccggtgcgccatttataaaaattgaagcgacaaaatttacagaagtcggctatgtaggcagagatgttgaatcaatggtcagagacctcgttgagacatccgtgcggctcattaaagaagaaaaaatcagcgaagtgaaagaacaggctgaagaaaatgcaaacaaacgtatagtgcggcttctcgttccgggaaagaaaaaacaagcgggtgtgaaaaatccgtttgaaatgcttttcggaggaagccaggcggcaaatgatgatgaaaccgaccagcaggaagaagcaagccttgaagagaaaagaaagcgcatggcgcatcagctcgcattgggagagctcgaagaccattacgtctccgtagaggtggaagagcagcagccgtcgatgtttgacatgctgcaaggctccgggatggagcagatgggcatgaatatgcaggatgcgctgagcaatctggtgccaaaaaagaaaaaacgccgcaaaatgacggtcagagaagcaaggaaggttctgaccaatgaagaggcaggcaaattaatcgatatggatgaagtcggccaagaggccgtgttaagagctgaagagggcggcattatctttattgacgaaatagataaaatcgcaaaaaacggaggggcttcttcctcagcagatgtatcgagagaaggcgttcaaagagatatccttccgattgtcgaaggctctaccgtcgtcacgaaatacggctccgtcaaaacagatcacgtgctgtttatcgcagccggggcattccatatggcaaaaccgtctgatctgattccggagctgcagggccgctttccgattcgtgtagaattgagcaagctgacggtagatgattttgtgaagattctcgtcgaacccgataacgcgctgttaaaacaatatcaggctttattgcagacagaaggtatatctcttgaattttctgacgaagctattcgtaagatcgccgaagtggcttatcatgtgaatcaggatacggacaacatcggagcgagaaggcttcacacgatattggaacgtctcttggaagacctgtcgtttgaagcgccggacgtaacgatggaaaaagtagccatcacgccgcaatacgttgaagaaaagctcggaacgattgcaaacaacaaagatctaagtcaatttatattgtgaaaatttaataagaggaattctaggaggattatttatcatggctttactacaaaaaacacgaattattaacagcatgctgcaggctgcggcaggcaaacccgtaaactttaaagaaatggctgaaacgcttcgtgacgtcattgattctaatattttcgtcgtcagccgcagaggaaagcttttgggctactctattaatcagcagattgaaaatgaccgcatgaaaaaaatgcttgaagaccgccagttcccggaagagtacacgagaaatctgttcaatgttccggagacgtcttcaaaccttgatatcaacagcgaatacacggcgtttcctgtggaaaacagagacctgttccaagcgggcttaacaacgatcgtgccgatcatcggcggaggagagagactgggcacgctcattctgtcccgtctgcagaatcaatttgaagatgatgatctaattcttgctgaatacggagcaaccgttgtaggaatggagattttaagagaaaaagcggaagaaatcgaagaagaggcgcgaagcaaagcagttgttcaaatggcgatcagttctctgtcttacagtgaacttgaagcgattgagcatatctttgaagagcttgacggaaacgaaggcttgcttgtggcaagtaagattgcggaccgtgtcggcattacgcgttcagtcatcgttaacgcgctgagaaaactggaaagcgcaggcgtcattgaatccagatcactgggaatgaaggggacgtacattaaagttctgaacaacaaattccttattgaattggaaaaccttaaatctcattaagaaaaaagcaggatccctgaaaatgggggtcctgctttttttatggacaataggtgaaaagttgcagtttaaagttgcttattggaatctgatctgagataatccatcttgctgtgtgaaaaaaggaggaagatacagaaattctgctattttcagtcttatattaaacaaatccttgtagtacaaatattctaggacttaatacctacatgtaaaatagatataattgagcacttttttttagcctaacttcatagactttaagcctgttatttcttacaataagtatatggttttacaattctcgacaaggatttttaggagaaaaatatctgaaatggaggtaagtggatttggacttattttctggaactatacaaaatcttgagaatgccttggggagagcggacattaagcaaaaagtcttaactaataatatcgccaatatagatacaccgaactataaggcaaaaaaagtctctttccgaaatttgttagatcaggaaacatccaatcttgaggctgtaaaaaccgactatcggcacgttgactttacgggttcgggggacgattattctatcgtgtccagcagtgatacatcgtaccagcaaaacggaaacaatgtcgatatcgacaaagaaatgacagatttagccgaaaaccaaattaattatcaggctttggttgaaagaatgagcggcaaattcaattctctgaaaaccgtcttgacaggaggaaaataatgagtggctttcaaagcttaaatatttcgggttccgctttaactgcacagcgtgtccggatggacgtcgtatcgtccaatctggccaatatggatacaacgagagcgaagcaggtaaatggcgaatgggtgccttatagaagaaagctggtatctctccaatccggaggcgaatcattttcgtcccttttacattccaagatgaacggaacagggagcgcgggaaatggcgtaaaggtatctggtgttacggaagacccgtccgcttttaatctcgtttatgatccggagaatcctgatgcgaataaagacggatatgtacaaaaaccaaatgtagatccattaaaggaaatggtggatcttgtcagcagcacgagatcatatgaagcaaacgtaactgcattaaacgcctccaaaggcatgcttttgaaggctttagaaatcggaaagtaaggtgatgtaagtggttaacgctattactccttttcagcttcaacaaacccaaaacactcaaaacgtaacgaatcaattaaaccaaactcaaaaaactgattcttcaaaccaaacaaacttttcggagcttttaaaaaactctattgattcgttaaatgagtcacaagtgaaatctgaccaaatatcgaacgaactggctgcaggaaaggatgtaaaccttgacgaggtcatgatcgctgcccaaaaagcaaatatttctctgacggccgctaccgaattccgcaataaagccgtggaagcctatcaggagatcatgagaatgcagatgtagtggtcagattgaagagaatgactggaatgaccgggggttaacatgaatcgtactctaatgcaaatgaaaaccaaaacggcagcgttttggaacaacagatcaaaaacacagaagatactcatggtaagcggcttggccgcattcattattttactcatcgtcgttattatttttacttcgtctgaaaagatggtgcctctttataaagatttgtccgcggaagaagcggggaagattaaagaagagctcgatacgaaaaaggtgtcttctgaacttgctgacggcggcacggtcattaaggttcctgagagccaagtggattcgcttaaagtccagcttgccgcggaaggcctgccgaaaacgggatcaattgattattcgtttttcggacaaaatgcgggcttcggcctgacggataatgagtttgacgttttaaaggttgaggcgactcagaccgaattgtcaaacctgataaatgaaatggacggtattaaaagctcgaaggtcatgatcaatatgccgaaagaagccgtgttcgtcggtgaagatcagccggcagcgtccgcatcaatcgttttgcagatgaaaccgggctactcgcttgatcaaaaccagatcaacgggctgtaccatctcgtttctaaaagtgttccgaacttaaaagaagataatatcgtcataatggatcaaaattctacatattatgacaaaagtgacagcggtgcagggtccgtttctgacagttatgcttctcagcaaggtattaagtcgcaggtcgaaaaggacgttcaaaaacatgttcagtcactgctcggcacaatgatggggcaggataaggtcgttgtttccgtgacggcggatattgacttcacgaaggaaaaacgcactgaagacactgtcgaacctgtcgataaagataacatggaaggcatagcggtaagcgccgaaaaagttgcggaaacgtataaaggcgacggcgcggccaacggcggcacggccggaacgggaagcaatgacaccgcgaactatgccgagacaaacggcggttcaaacagcggcgactacgaaaaaagcagcaataaaatcaactatgaagtcaaccgcattcataaagaaatcgctgaaagcccgtataaagtgcgtgatttaggcattcaggtcatggtggagccgcctaatccgaaaaatgccgcttccttatcagcacagagacaggctgatatacagaagattttaggaacggtcgtcagaacgtctcttgataaaaacgaaacgcaaaatcaaaacctgacagacaatgatatcaacaataaaatcgttgtatccgttcagccgtttgacggaaaaacaagcctgaacacagattcggcacaatcttcaggtcttccgatctgggtatacattacaggcggcgtactgcttgcggccattattctgcttattattctccttatcagaaagaaacgctcacaagaggatgaatacgaagaatatgaatatgaaacaccgccggagccggttcgattgcctgatatcaacgaagagaaaattgaaacggaagaaacagtcagacgaaaacagcttgaaaaaatggctaaagaaaaaccggaagactttgctaaattgcttcgaagctggctggacgaggattagggggaatggaaaatggcgaaacgtgatcagaacaagcttacaggaaaacaaaaagcagccatcctcatgatttccttaggccttgatgtatcagcttctgtgtacaagcatttgtctgaagaagaaattgaaagattgacactcgagatttcgggagtcagaagcgtcgatcatcaaagaaaagatgaaatcattgaagaatttcataatatcgcaatcgctcaggactatatttcacaaggcggtttaaattacgcccgccaagtgcttgaaaaagcgctcggagaagacaaagcggtaagcattttaaacaggctcacctcttctttgcaggtaaagccgtttgatttcgcgagaaaagcggagcccgaacagattttaaatttcattcagcaggaacatccgcaaacgatggcgctgattttatcctaccttgacccggtgcaggccggacagattttgtctgagctgaacccggacgttcaggctgaggtggcaagaaggattgcggttatggacagaacgtctcctgaaatcataaatgaagtggagcgggtccttgaacaaaagctgtcctcctcctttacgcaggactatacgcagaccggcggcatagaagccgttgttgaagtgttaaacggcgtagacagaggaacggaaaaaacgatccttgattcattagaaatccaagatcctgagttggcggatgaaatcaaaaaacggatgtttgtctttgaagatattgtcacccttgataaccgtgcgattcagcgcgtgatcagagacgttgaaaacgacgacctcctgctttcattgaaggttgcgagcgaggaagtcaaagaaatcgtcttcagcaatatgtcacagcgtatggttgaaacgtttaaagaggaaatggaaattatggggcctgtgcgtttgcgtgatgtggaagaggcgcaatcaagaatcgtgggcgtcgtccgcaagctggaagaagccggagaaattgtaatcgcgcgaggcggaggagacgatattattgtctaatatcattaaacagcaatcatcattttctcctgaacaaaaacggcgcaagctttccttgcaggaagtcaggaaaacacattcccagccagaccgggaggaacccgaaaatccagaggctctcatggcttttgccaaagcagaagccgacagggtgtctgaagaagcgaaaaatcaatttgagcacactcttcgtcagattgaagaagagaaacaccgctgggcggaagaaaaacaaagattgatagaagaagcaaaggcagaaggatatgaagaaggcatggcattgggaaaagccgaggctcaagctgaatacgccaatctcatcagccgggccaatgccgttatggaaatggcgagacagtcagtcgaggaaaaactggaaagcgctgaggaagaaatcattgagctttccgttgcgctcgctaaaaaagtatggcggcaaaaaagtgatgataaagaggctttccttctgctggtcaaacaggtagtagccgaagtaaaagattatgatgacatctccatctatgtggaccctgaatattatgagacggttcatcagcatatggacgaaattcagcagctgttatacaaagaatgcagattaagcttatatgccgatgaaaaagccgcgaagggaacgtgctcgatagaaactccgttcggacgtgtcgatgcaggcatagatacccagctgatgcaattaaagcaaaaacttttaacggcgcttgaggcgggagcggagcaatgaagacacagtatttaatagactcaattgaaacagcggatccgtacaagcgctacggcaaggttaaacgggtcatcgggctgatgattgaatcaaaagggcccgaaagctcaatcggagatgtttgtctcatttatccgaaaggccatgcgaaaaaagcgattaaagctgaggttgtaggcttccaggatgaaaacattctgttaatgccttatctggaagcggccagcatcgcgccgggcagcattgtggaggccactggcgagtcgctccgcatcaaagtaggcgcgggtttaatcggacaagttgtcgacgcgttcggcgagcctcttgacggccgggcgcttccgaaaggtttgtcccccgtttcgacggaacagccgcctccaaacccgatgaaacgcccgccgatacgggaaaagatgggtgtcggcgtcagatcgattgacagtctgctgacggtaggaaaagggcagagaatcgggatttttgccggaagcggggtcggaaaaagcaccctgatgggaatgatcgcgaagcagactgaagctgatttaaacattatcgcactcgtcggtgaacgggggcgcgaggtgcgtgaattcatcgagaaggatttaggcgaagaaggcctgaaacgctcgatcgtcgtagtcgcgacctctgatcagcccgccttaatgcgtttgaaagcggcgtatacggccaccgccattgcagagtatttccgcgataaaggccggaatgtgatgttcatgatggactccgtcacgagggtcgcgatggctcagcgggaaatcggcctggcagcgggagaaccgccgacaacaaaaggatatacaccttccgtgttcgctattttgccccgtttgctggaaagaacgggcgcgaatgaacaaggaacgataaccgctttttatacggttctcgttgacggagatgatatgaacgaaccgattgccgatacggtgcgcggaatattagacgggcatatcgttctcgatcgggcgcttgccaacaaagggcagttcccggccgtgaatatcctgaaaagcatcagcagggtcatgtctaatatttcagacacatcgcatatagaggcggccaacaaattccgcgatcttctgtcaacttatcaaaactctgaagatctcattaatatcggagcttacaaaagagggtcatcaagagaaattgatgaagcgattcagttttatccgcagcttattcaatttttaaaacaaggaacggaagaacctgctcaattggaagacagcattgcggcattgacgagtctgacaggaaaagaggaataaacatcgtggcataccaattcagatttcaaaagctgctggaattaaaagaaaatgaaaaagaccaaacattgactgaatacagacaatcggtttctgaatttgagacagtggctgaaaaactatatgaaaatatgagcaaaaaagaattgctcgaaaaagacaaagaatcaaagctgaaatgcgggatgagcgttcaggaaatgagacattatcagcaattcgtttccaatcttgagaacaccatctatcattatcaaaagcttgtcatcatgaaacgaaatgaaatgaatgagaagcaggaacagctcaccgaaaaaaacattgaagtaaagaaatttgaaaaaatgcgggaaaaacaatttaatatgttcgcacttgaagacaaagctgcagagatgagggaaatggacgacatttcaatcaagcagtttatgattcaggggcattaggagcgaatgaaatggccgataaagaaaagagatctggaaagttcggttcaatcctgctttttatcatgatcccgctgatttttctgatcatcgtcgcaagcatcatcctttgggctgccggcgttgatgtgatgaagccgattcaggaaacagccgctaaaacgcctgttttaaaagaattggttcccgaaacgaaagaaatgaaaagcgcggcggaaaagcagaaggaagacagaacggcttctcttgaaaagaccataaaggaacaaaaaagtgaaattaacattttgaataaagatttagacacaagcaagtccgaaatcgataatctgaatcagaaaatccgttcactgaaacaggaagctgaacagcagcagaaaacgaagacggatgaaacgaaaaaagacgctgcggattcagccggaaaagataaaatgatcaacatctataaaagtatggacagcggtaaagcggcaagcattatcgtaaagctgaaagaaaaagaagccctcgatattttaaacggattaagtaaaaagcagcttgctgaaatcttgacgaaaatgactcctgaacaagcggctaaatatacagaaaaactatccgctgacggaaataaggagtgatgtaagttgaagctgcttgaattaacgggtaatcgtacgcagactgcgcaaaacagcaatgtgaagatgaatgtaaacagcttaggtctatttcagaactggctcctgtcggaaatcacttctccccggcagcccggagatgaaacaaaaacaagtgacgcagagctgaatgatgccctatcgaaaatcggtgattggctgaaagccggcccggaagataaagaattgcagctgaaacagctgcttgaggcggtaaaagctcttgaaggaaagcagacggctgaaacagctcttcctttattgaaacagcttgccgaatctgttgaagacatgttagcgggaaaacagcatggggagaagcctgaaacggatgaaccggattcttccgcaaaagacggggattccgtcaaggatgcgcttgagaagggcctgctgttcattcaagaagccgtatcccagctcttcacatctcagcaggaactgccggacagcgcgcaggcaaaggcggtttaccaggaaggcgcccgtttattagaggcattgaaaaaacaaggtgtcccggaccgcgtgattcaagacctgcggcagacattttttccgaaaaacgaatctgcatctaaactttactccatgacagccgctgagctgaagagctttcaaagcgtcacggagcagcttgcgggcctttctcaaaaggggacaaaggattgggatatggctgaaactgagctgaaagcttttgtgttatctcaatcatctgaatcatcccaagagtcagccgggaaaacagaacagcaaaacggcacggtttctcacgcaaaggcacctgacagcaaattgtctgcacatatactgttttcgggaacgagaagccttgccggcattcagcaagcgtccgcaggagctgaacagcagcaggcagaaaataaaccgttaacggatcaggtcatcagcggctggaaacagatgaaatacacgcctttcgggaaaacaaccggaagctttacgattcgtcttaatcccgagaacctcggatttgtcacaattaaggtgacaaatgaaaacgggatgtttcaaagcaaaataatcgcatccagccagtccgcgaaagagctgctggaacagcatcttcctcagctgaaacagtcgcttccgaatatgtcggtccaggtcgaccgttttacagtcccgcttcaaagcggggatcagcagcctgtttacgggcagacggccgatcacaataaacagcagcatcagggacagagagagcagaagaaccagcagcagtcaggcgatttcggagatatgctggaggagctttctctcaatgaaatggaggaagaatagttgacatcagtaaactcggattatgccgcggcgggcgcttcaaccacttcaagcgcgaagagcacctccgcagtaaacagcagcacgaatttagggaaagacgaatttctgaagatcttaatgacacaggttcaaaaccaggacccgctcaatccggttgatgacaaagaattcatcagccagatggcgacattttcttcattggagcaaatgatgaatatgaatacgacgatgactaaatttgtagaaaatcaagatccgtttacgatgtatgtgaactggatcggcaaaaatgtcacattcagcgacagcgacgggaaggatcagacaagcccagtcaattcagtcaagcattcaaacggcaattacgtgctcgtgcttgaaaatggcaaagaggtcagtccgtggaatgtcacggccgtcagcgaaacatctaaataataagaaactcagggggaatttaacatgttacgttcattatattccggtatcagcggcatgaaaaactttcagacaaaactagatgtaatcggcaataacatcgccaacgtcaacacagtgggatttaagaaaagccgcgttacatttaaagatatgatcagccagacagtcgccggcggttcaaacgtgaccaattcaaaacaaatcggcttgggtgccgcgacttcttccattgatgttgttcattcaaccggcgccccgcaggctacacagaataaaaccgacctagccattgacggagacggctactttcagattaatacaggtgcgggaattgtttacacacgtgcggggaatttcggtaaggacaatcaagggaaccttgttacgactgacgggtactaccttgaaaaaatcggcggcggtaaaatcaatattccgactgatgcgaaagattacagcatcggtgcagacggaaccgttacatatactgatgcaggggatgaggttcatgatgccggacaaatcggtctggtcacgttccctaacagcgccggtctggaaaaaatcggaggcaacctttacagagaatcattaagttcaggagctgcgagcgcagtcaccactccgggcgaaaacggaacgggtaagcttttggcaggctatcttgaaatgtcaaacgtagatctgacagatgaatttaccgaaatgatcgttgctcagcggggtttccaatcaaactcaaaaatcattacgacttcagatgaaatccttcaggagctggttaatctgaaacggtaaggagggaggagaggcggttaagccgcttctccggattgcatgattcaagtcacccgtttaaacggccagccttttacgctgaacgcgctgtttatcgaacagattgagtgcttccccgacacgacgattacactgtccaacggcaaaaagttcgtagtgaaagaaccggaagaagcagttctcaaaaaagtcatatcgttttaccatagcatacaaatattttcactggatcagggaatagaggaagaagaatgaagaaaaaattagtcatcattttgctgattattttaattgtcatcgccggcctcggaacggcagcatattttgtcgtcagcggaaattcgggcaaagataaaaagccgacaattgacgaagtcgttgcagccactgtgtctgtcgacgatatcacgacaaacttaaagtctgacagcatcatccgtatcggcatcaagcttgaaaccgactcggctaaagcgaaggaagaacttgaaaaacgcgattttcaggtgaaagacaacatcatttccattttagccgacacaagcgccggagagattgagggagataaaggaagagaagcgtttaaacaatcattaaaagagaaagtaaacagctatctccaagaaggaaaagttcagaaagtgtacattacctcctttaatctgcaataaaaacaaatttgacagaatacggaggtgaagaaaatgtcaggagaagttctctcccaaaatgaaatagacgcactgctttccgccatttccacgggtgaggcggatgcggaagagctgaaaaaggaagtaaaagagaaaaaagtaaaggtatatgattttaaacgggctctcagattctcgaaagatcagatacgcagtttaacccggatacatgataactttgcgaggcttctcacaacacacttttccgccaagctcagaacgtatattcatatatccgtcagctcagttgatcaggtgccgtatgaagaatttatccgttccataccgaacatgacgattttaaatttattcgatgttcatccgatggaaggcagaatcatgatggaggttaatcccaccatcgcatacgcaatgcttgaccgcgtcatgggaggcatcggcatcactcataacaaagctgacagccttacggaaattgaaacgaatattatttctaatttatttgaaaatgcactgggcaactacaaagaagcttggcaatcgattgctgatattgaccctgaaatgactgaatttgaagtgaatcctcagtttgtacagatggtttccccaaatgaaacagtcgttgtcatttctctcaatacacagataggtgaaatcagcggtgtcattaatctttgtattccccatgtcgtacttgagccgattatccctaagctttccgtacattattggatgcaatcagaccggaatgaagcgaagcccgaagaaacgaagttgcttgaaaagcgcatcatgacggctcaaattcccgttgtggctctattgggcgcttctgaactgacaatagaagaatttttaagtttggaagtcggggactgtataactctggacaaatcagtgactgatcctcttactgtattggtcggaaacaaaccgaagtttttagggcaggccggccgggtgaatcgaagacaggcagtgcaaattttagatcacgacataagaggtgaacaagatgaacaatagattatctcaagatgaaatcgatgctcttcttaacggcacaagcagtcaatcagaggatacagaacagcctcaaggggcgaacttgtctgaacttgagcgcgatgcgatcggagaaatcgggaatatttcgttcggcagctcggctacggcgctgtccactcttttaaatcaaaaagtggacattacaacaccgagtgtgaccgtcatttcaaaaagcaaaatcagtgatgaatttcctcatccgtatgttgccattgaagtgaactacacagaaggctttgacggcagcaatttgctcgtcgtcgaacaaagcgacgcggccatcatcgcggatttgatgatcggcggagacggccggggcgccgatccgtcactcggtgaaatccacctgagcgccgttcaggaagcaatgaatcaaatgatgggctcggctgctacgtcaatgtcgaccgtgttcagtaaaaagattgacatttctccgccaagggttgaacttctggatttgacggaagaaaaagggaccgacagaatacctgaggatgacctgctcgtaaaagtgtcattccgtctgaaagtcggtgaattaatcgattcgagcatcatgcagctttatccgattacgtttgcgaaagatctgatcgcagaactgatgactgcagaccagcatgagtcagaggccgcagaaaccgtatcagaaccacaggaaacatacgaaacgccgcagccggaacctgccatgcagccggagccgcaggcaaaacccgagcttccgaagagacagggaaccgcaaaaaaagctgctcctgttcaagtcgctccggtggaattccaggcgtttgatcataacgaagcggcgcaaggatcaaggaataaccttgatatgctgatggatattccgctttccgttacggttgagctcggcagaacgaagagaagcgtcaaagaaatccttgaactttctgcgggaagcattattgagcttgacaagctggctggtgaacctgttgacatcctggtcaaccagcggatcgtggcaaaaggcgaggtcgtcgtcatagaagaaaacttcggcgtgagagtcactgatattttaagtcaggcagaccgccttaacaatttaaaataagcgaacatagaggagagaaacagattatggcacacagaattttaattgtagacgatgcagcatttatgagaatgatgatcaaagatattttagtgaagaacggttttgacgttgtagctgaagcttcagacggagcgcaggcggtcgaaaaattcaaagagcattcccccgaccttgtgacaatggatattacaatgcctgaaatggacgggattacagctctaaaggaaattaaacaaatcgatccgcaggcgaaaatcatcatgtgttcggctatgggccagcagtcaatggttattgacgcgattcaagccggcgcaaaagactttatcgtgaaaccgttccaagcggaccgcgtgcttgaagccattaataaaacattaagctaaagggtgtacgactgttgaaaaagagtcatggtttactagctttgatttgttgtttcgttttactcaatgtacatccgttccctgcttttgcggcggagtctgacaattccaccgtcaacgaatggtttgacaaacaatcaacaaacaaaacagagaaaaaaagcgatacatcgaaacaaacggctgatcaagagataggggatgcttctgcatcttctgtctccgcttttgattttgtaaagatgattggggcgttattattcgtcattctgctgatctatggatttgtcaaactgatgaatagaagaaaccgtctgttgaagccgtttcaatatgtagaaaatatcggcggaacgtcagtcggccaaaaccgttccgtgcagctgattaaagtgggaaacagcgttctcgtagtcggtgtgggcgaaacgatacagcttttaaaagaaattgaagatgaaaaagagcgcgaggcgattctgagccaatacgaagagtcgatgtcttcaaaagtggaatggaccaagctcgtaaatccgcgtaaggatggagaaaaaaagccgcaaacgatgcttccgtcgttttcaaaagcgctgaaagaacagttgaacgagctgaaacaaagccgttctgaaggaaagaagaaaggcccttatcatcatgaatgaatttattaatctttttaattcaagcagtccgaccgaagtcagctccactgttaaattactgctgcttttgactgtcttttcagtggcgccggggattctgattttgatgacctgctttacgagaatcgtcatcgtcctgtcttttgtgagaacctcactggcgacgcagaacatgcctcccaaccaggttttaatcggccttgcgctgttcttgacgttttttattatggcgccgactttttcagagattaataaggaagccttaacgccgctgatggacaacaaaatcagtctcgatgaagcatatacaaaagccgagaagccgattaaagagtatatgagcaagcatacaaggcagaaggatctggcgctgtttatgaactatgccaagatgaaaaaacctgaatcgattcaggatattcctttgacgacgatggtgcccgcttatgcgatatcagaactcaaaaccgcttttcaaatgggctttatgatttttattccgtttttaattatcgatatggtcgtggcgagcgtcttaatgtcaatgggaatgatgatgcttccgccggttatgatctctctgccctttaaaatattgcttttcgttttggtcgatggatggtatttaatcgtgaaatctttgcttgacagcttttagggtaggtgctaattgtgagttcagaatttgtaatttccatggcggaaaaagccgtatatgtaacactaatgatcagtgggccgctgcttgcgatcgcgctgatcgtcggtttgctcgtcagtatctttcaagcgacaactcaaatacaggaacagacgcttgcgttcattccgaaaatcgtggcggtgatgcttggactgatctttttcggtccttggatgctgtcgacgattctttcgttcacaactgatctgttttctcatctgaaccgatttgcagggtagaatcaaatgaattccatcattgatttatttcccgcttttttattggtctttatcagaatctctgctttttttgtaacggtgccggtgttcggacatcggaatctgccggcggttcaccgaatcggctttgctttttttctttcggtgatctgcttcagcacgctgaaacatgcgccggaaatagaaataggggaacagtatatgctgcttgtcataaaagaggccgttgtgggcttgagcctcgggctgatcgctttcatgatgatgacagccattcagatagcaggttcctttattgattttcagatgggcttttccatcgccaatgtcattgatccgcaatcaggaacgcaaagcccgctgatcggacaattcgtttatacgcttgcgctgttatttatgctcagcgtaaacgcccattatcttttattggacgggatttattacagctttcagtatatcccgcttgaccaggcatttccgtcgtttggaaatgatcagtttggactttttatcgcaaaaagcttcagtgccatgtttattatcgcttttcaaatgtctgcgccggttgtggccagtctgtttttagttgatttggcgctcggtattgtagcgagaacggtgccgcagctgaatgttttcgttgtcgggcttcctctgaaaatagccgtgagctttattatgctgatcgtttgtatgtcggtgatgtttgtcgtcgtccgcaacatcttcagccttaccgttgaaaccatgcggaatctattggcattggtcggtgtgacatgatgagactcagactgaatctgcaattctttgccggtgaaaaaacggagaaagccactccgaaaaaacggaaggatacaagaaagaaaggacaggtcgcgaaaagtacggatgtgaatacagccgtttctttactgattatctttctttcgctgatcgcgctcggtccttatatgcgggacaggctgctgtcctttattaaaacgttttatacgaaatcgataacattacacctgtcagcatctgccgtgcatgaactgttcgtggatacggtgaaagatatcagcctcatcctcgcgccgattatgctggtcgcgcttgtggcaggtgtcgtgagcaattacatgcaggtgggttttctgttttctgcggaagtcctcaagcctgacttgaataagctcagcccgctgaaaggatttaagcggatttacagcatgagggcgattgttgaactggtcaaatccattttgaagattactgtggtcggttttgccgcctttatggtgctctggcttcattatggcgatattcttcgccttccgcttttaacgcctgcggaagtgctcactttcgtttctaagctcacgctttggatggggcttgcgggatcaggggctttaatgctgctggccgggcttgattatttatatcagcgttttgactatgagaaaaatatcagaatgtcaaagcaggatataaaagatgaatacaaaaaatcggagggtgatccgataatcaagtccaaaattaagcagaagcagcgggaaatggcgatgaggcggatgatgcaggaagtgccgaaagcggatgtcatcattaccaacccgacccattatgcgatagctttaaaatatgatgaaaagaaaatggacgccccttacattgttgccaaaggggtcgaccatctcgcattaaaaatcaggcagatcgccaaagaacacgatgtcatgacgattgaaaacaggccgctcgcgcgtgcgttatatgatcaggttgacattgaccaggctgtgccggaagagtttttcaaagtcattgcggaaattttggcttatgtatataaaacgaaacaaaaagtatagtgaatttcagattcaaaaggagagaaaaacagcatgtcaacaagagatttatcggttttaataagtgttgtcctcattgtggcaatgctggtgattccattccctccatggttgttaagtattttgatcatcattaatatctctcttgcgttgatcgtgcttctcaccacaatgaatatgcaagaaccgctgcaattctcgatattcccgtcattgctgctgttattgacgctgtttcggctttcgctcaatgtgtcgacgacacgttcgattctttctcacggagaaggaggaaaggttgttgagacattcgggaatttcgttgtcggcggaaatgtgctggtagggcttgttgtcttcattatcttgattattattcagtttatcgtcattacaaaaggcgccgagcgggtatcggaagtggcggcgagatttacgctcgatgcgatgcccggaaagcaaatgagtattgacgcggatttaaatgccggcatgattacggagcaggatgcaaagcacagacgtgaaaaagtcgcccgggaagccgatttttacggcgccatggacggtgcgagcaaattcgtcaaaggagatgccatcgcgggtatcatcatcgtgatgatcaatattattttcggaatcgtaatcggcatgctgcagcaggggatgagcatacaagaagctgcgtctcactttacaatgctgacggtcggtgacggtatcgtttctcaaatgccggctttgctcatctcaacggctacggggattgtcgtgacgagagcggcatctgaaggaaacctcggtcatgatattacaggccagctgtttgcttatccgaagctcttgtatgtagccgcgggaactgtacttttgctcggtcttcttacaccgatcggcattctgctgacgggaccgatcgccggtctgcttgcattcggcgcttacatgctgtccaaaacggataagccgagcgaagaagaggaagaaattcttgaagaagaggctcaggcggatgaactgaaaagcccggaaagcgtcgtgcagcttttacatattgatccgattgaatttgagttcggatacggactcgtgccgcttgcagacgcggggcagggcggtgatcttcttgaccgcatcgtcatgatcagacgtcagcttgcgcttgaattgggacttgtcattccggttgtgcgcatcagggataacatcgcgctccagccgaatgaatacagattgaaaattaaaggcaatgaagtcgctaaaggagagctcctgctggatcattacttagcgatgtcaccgacgcctgaagatgacgtcattgaaggaattgaaacgattgaaccgtcgttcggacttcctgcaaaatggatcagcgaagctgcgaaagatgaagcagacatgctggggtatacagttgttgatccggcgtcagtcgtatctacgcatattacagaaaaaattaagcagcatgcccatgaactggtcggcagacaggaaacaaagcagctgatcgatcatctgaaggaaaattatcctgtgcttgttgaggaagtcacgccaaaccctctttctgtcggcgatattcaaaaggtgcttgccaaattgctgagagaaaaagtgtcaatcagaaacttggtgaccatttttgaaactcttgccgattacggaagattaacgacagattcagaccttttgacagaatacgcgagacagtcgcttgccaaacaaatcacggcacaatatgcgagagagcatgaaacgctgaaggtcatcacatgctcaggccgggtggaaaaagcgattgcagacggggtacagcagactgaacagggcaattacctgtcactcgaccctgaggtttcagacagcatcatccgttctgtcgctaaagaggccgagcagctttccatccgtcaggagtcagcgattcttctttgctcgcctgctgtcagaatgtatgttaaacagctgttagaacggtatttccctgatcttccggttctttcttataatgagctggaagcaaatgttgaagtacagagcattggagtggtggatatttaatgaaaataaaaaaaattacagccgcttcaatgcaggatgccgcgaagcaaatcaaaaaggaactcggcaatgatgccgttattttacattccaaacaagtaaagaaacgaaaatggctggggctgcggccgcagcaggccgttgaagtgatagcggttttagatcgtgacgtcagggaagcgagaaaaacgccgccggctgccgctgaagaaatgaaaaagacggaaacggcggagaaagctgagcctgttcagccgccgcgtcttccggatcaaagcatttccggcgaactggcgcattataaagaagtgctccctgaaccattaaaaaaagccgagagactattgaagcaagccgggcttcctgatcatacgcaaaacgccgtgctcagtgaattgctccgttcttcaattgtttccggagatttaactgaagataatgtcagctcaaaactgcaggatttgttagtgaaaaaactcccttcggcagacaggtggcaggaagggattcaatcaaaatacgtcgtgcttttcggttcaaccggggccggcaaaacgactacacttgcgaaactcgcggcctcatcaatgctgacagagcataaaaaaattgcatttatgacgacggatacttaccggattgccgcggtcgagcagctgaagacatatgcggagctgcttcaggctcctcttgaagtatgctattcaaaggaagaatgtctgaaggcactggaaaaattcgctgaatatgaccatgttttcattgatacagccggcagaaactttaaagaagagcagtatattacggaattacaagagatgattccgtttgaatcaggcttacaatcctttctcgtattatcagcatctgcaaaatatgaagatatgaaacaggtgctgaaacgtttttccggtgtgccggtcaatcaattcattttcacgaaaacggatgaaaccgcctcactcggctccgtgtttcaagtgctgtcggaatcaagaatcggcgccgcctatttgacaaatggacaggatgtgcctgaggacatcctatcggcttcaccaaaagagtttgtaaggatgcttttgacatgaaacccgatcaggcagagtcattaagaaggaaaatgagagagcggcaaatgatcaagccggagctttatgagaaaaaagcgaagacattagccgtcatcagcggtaaaggcggcgtcggaaaatctaatttaacattaaacatggcagttgccctgcaggaaaaaggaaaaaaagcactcatcattgatcttgacatcggaatgggcaacattgatgtgctgatcggcgctgcttcttcccgcaccattattgatgtgatggagaatcggcacgcattggcgcaatcactgtcctccggtccgaaaggccttcggtacatatccggaggaacggggcttgaggcgatctatcaagctgacggagagaagtgggcggcttttatgaatggtctttccgctgtattaagcgattttgattacgttctgtttgatatgggagcgggactttcaaacgaacagctgccgtttattttatcggcggaagacattctcgccgtgacaacgcctgagccgacggccattatggatgcctacagcgcgatcaaacatcttttgctcgcggatgaacggctgaccgtaaacattgccgtcaatcgcgcccgctcccaaaaacaggcgctggacacgtacaaccgcctttctcatgcgattcacacgtttttaggcgcggaagtgcgtttcgccggctccatacccgatgacccgctagtaagtcaagccgtcattgaccaggtgccttttttaataaaaagtcctcaagcaaaagccagcaggtccgtccgtcttctgacggatgtcttgtttcaaacggaagaaaacaaaccaagagaagagaaaccggcatttattgagagattatcttcttttttattgaggaggactttacagtgattcgtgtgcttgtcgttgatgactcagcttttatgagaaagatgattaccgattttctggctgcggaagtgcagatagaagtcatcgggacagccagaaacggggaagaggcgctgaagaaaatagagcttctcaaaccggatgttgtcacgcttgatattgaaatgccggtcatgaacggaacggatacattgcggaagatcatcagcatatataaacttcccgtaatcatggtatcgagccagacacaacaagggaaggaccgaacgatcaactgcctggaaatgggcgcttttgattttatcaccaagccttccggagcgatttcccttgatctttataaaattaaagagcagctgattgagagggtgattgcagccgggctgtcccgcgcacaaaaacctgaggcggcagtgaaagagtcttctatcccggaacgtccggctttagcgggatttgaaagaccgaaagcaaaatccgccaagcaggccgtattcatcgcgacctctacaggcggaccgcgggctctgcaaaaggtgattccgaaactgccgaaggatttaaaggcgcctgtatttgtcgttcagcacatgcctgaaggcttcaccgcttcacttgcagacagactcaaccatttgtcagatattcaggtcaaagaagcggaaaacggtgaagaagcgaaagacggatgggtgtacatcgcgcccggcggaaaaaatatgacggttgcagaggaaggcggaaggctccgcatcattcttgacgttcatgatacggaaagccggcataaaccgtcagccgattatttgtttcggtcggcaagccgcttatccgattacgaaaaggtagccgtcattatgaccggcatgggcagcgacggaaccgagggcgtaaaagaaatgctcagaacaggcggcgttaaaacgattgcggaatcggacgaatcctgtgttgtgttcggaatgccgaagtcagcgataaaggcgggcctcattcatgagattaaacatgtggaagatatcgcggcatccatcaccggatgtgtgaaaaaagagagggtgtgaatcaattggatatgaatcaatatttagatgtctttattgatgaaagtaaagagcacttacagacatgtaacgaaaagctgctgctgttggaaaaagatccggcagaccttcagcttgtgcatgacatcttcagagctgcccatacgctgaaaggcatgagcgcaacgatgggatatacagatctggcgcatttaacccacctgatggaaaatgtgctggacgccatccgcaacggagaaatgcccgttacatcggattggctggatgtgctgtttgaagcgcttgatcatcttgaagagatggtgcagtccattattgacggaggagacggcaaacgtgatatttctgaagtgagtgcgaagctcgacgtaaatgcggtgcatgagactgcggcttcagccgaaacagcagaaccgccggcttcaaaacaacaggcttcaactgaatggaattatgatgagttcgaacggactgttattgaagaggcggaagagcaaggattcagccgctatgaaataacggtttccctgaatgaaagctgcatgctgaaagccgtgcgggtgtacatgatttttgaaaagctgaatgaagccggagaagtcgcaaaaacgatacctgccgcggaagtgcttgagacggaagatttcggaacggattttcaggtgtgtttcttgacaaagcagcctgctgaagaaattaaagaactcatcagcggcatttcagaagtggagaatgtcgaaatttctgccggtgcgccgttaaaaacggccgaaaaaccgcaagcggctgaaccggtgaaggaagctccggttaaaaaggctgagaaacagccaaagccgcaagcgaaaacggaagaacagccgaagcatcacagcggctcgaaaacgattcgcgtcaacattgaaagactggattcttcaatgaacctttttgaagaacttgtcattgaccgcggacgtcttgagcagatcgccaaggagcttgaccacaatgagctgactgaaaccgttgaacgcctgaccagaatctcgggcgaccttcagtctattattcttaatatgcggatggtgccggtagaaaccgtctttaaccgtttcccgagaatgatccgccagcttcaaaaggaattaaacaagaaaatcgaattgtccatcatcggagctgaaacggagctggaccgtacggtgattgatgaaatcggcgatccgcttgtccatttaatcagaaacagcatcgatcacggcattgaatcgcctgaagtgcgggtgaataaaggaaaatcagaatcaggtcatgtcgtgcttaaggcatatcacagcggcaatcacgtctttattgaggttgaagatgacggggccggcttgaacagaaagaaaattcttgaaaaagcgctcgaacggagtgtaatcaccgaacgtgatgctgaaacgcttgaagataatgagatttacgagcttatttttgctccgggcttctcgactgccgatcaaatttctgacatttcagggaggggcgtcggtctggatgttgtgaaaaataaactcgaatcactcggcggctctgtcagtgtcaaatccgcggaaggccaaggttctcttttcagtatccagcttccgctgacactttcaattatatctgttcttctcattaaactggaagaagagacgtttgcgataccgatttcttctattatagagacggctgttattgataagaaagatatcctgcagacgcatgacagagaagtgattgatttcagaggccaaatcgttccgatcgtctatctgaaaaaagaattcggcattacggattcaaaacaggatgccgatcagttccatgtaatcgtcgtgaaaaagggcgataaatccactgcttttgtcgtggactcttttatcggacagcaggaagtcgtactgaaatcactcggcgactatttgacgaacgtctttgcgatttccggcgctacgattctcggaaacggagaagtggcgctgattattgattgtaatgcgctgatctactaaaacgacacgaggaggtgcccgaatgactgctgaaatcaaaacaggtgaaaaaatgattgtgtttatgataaacgggaaagaatacgctatctcagtttcccaggtgaaatcaattgaaaagtggcaaaaaccgacgagggtcccgggtgtggaatcttatatccgcggcgttatcaatctgcgcggagtgattaccccggttcttgatttaagaaaacgtctgaaccagcctgaacaggacatcacagaagagactcggattatcatcatttcttaccgtgacgctgatgtcggatgggtcgtggatgaggccaatgacgtcatcaccgtgcatgaaaatgaaatcgaatccgcgcctgaaagccagacaaaggaaacggatgtgtggattaaacagatcgttaagcaagataacaggctcctcaatattatcgatgcgcatgcggtgctggataaaggtgcttcggcatctgcgtccggagagcctaatgcttaaaggggaaaagacaacatgagtaagtttgaagcgatcaaagaagagcagatggatattttgcgggaagtcggaaatatcggggcgggtcactcggcttctgcaatggctcagctgctgaacagaaagatagacatggaagtgccgtttgcgactttattgacatttgatgagctcgctgattttttcggcggggctgaaacgccggtcgccagtatctttttaagaatggaaggcgacatgaccggctctatctttctcatcatgccttttgatcaggcggaacagtttatcagagagctgatcggaaatccggattttgatattgaccagctgggcgaagatcatttgagttcttctgctttacatgagttcggcaatattttagcaggttcctatttaacggcattggctgatttgacaaagcttgagatttacccgagcgtgccggaaatctcacttgatatgttcggcgcggttatcagtgaagggctgatggagctcagccaagtcggagagcatgccattgtcgtggatacttctatttttgaccagggcagccggcaggagctcaaagcccacatgtttatgctcccggactatgattcttttgaaaagctcttcgtctcattgggtgcggctttatgagccgtgcggaagccgcagtcgttaaagtggggattgcggatgttcaagtcgcgcgttacccggataaaatccggacctcgggactcggttcatgcgtggggctggttttatacgataaagacaaacaaacggcaggactcgttcacgtcatgctgccggactccggtttatcaaaaacggcggagctcaaccgtgcaaaatacgcggacaccgccgttaagatgacgattgatatgcttttgaaagccggctgccgcaagtttgccctgaaggcaaaactcgccgggggagcggagatgtttaagtttaaaatgacaaacgacctgatgaaaatcggtccgaggaatgtagcggccatcaaagagcagctttcattgtataacattccggtcatcagtgaagatacgggcggctcaagcggccggacgattgaatttgagccaaagtcctgcatgctgcacattcgaactgttaaacaaggtgaaacaacgatttaataaaggtatgaggtagggggataacaatgcaatccttgaattatgaagatcaggtgctttggtcgcgctggaaagagtggaaagatcctaaagccggtgatgatttaatgcgccgttacatgccgctggtcacatatcatgtcggcagaatttccgtcggactgccgaaatcggtgcataaagacgatctaatgagccttggtatgcttggtttatatgatgccctagaaaaatttgaccccggccgggatttaaaatttgatacctatgcctcgtttagaattcgcggtgcaatcatcgacgggctgcgtaaagaagattggctgcccagaacttcacgggagaagacaaaaaaagtcgaagcggcgatcgaaaaacttgaacagcgctaccttcggaatgtgacgccttcagagatcgcagaagagctggggatgacggagcaggacgtagtatcaacgatgaatgaagggttttttgccaatctcttatcaattgatgaaaagcttcacgaccaggatgacggtgagaatattcaagtgatgatcagagatgacaaaaatgtgccgccggaagaaaaaatcatgaaggacgagctgatcgctcagcttgcgggcaaaattcatgagctctctgaaaaagagcagcttgtcgtcagtttattctataaagaagaactgactttgaccgaaatcggacaagtcctgaacctttcgacgtcgcggatttcacagattcattcaaaggcgctgttcaaattaaagcacctgcttgaaaaagtaattcaataatgaactcatggttagcgagtgaaaaacatgtcaacactattatggcttttaagctttgtgcttcacggcgtactgctttatgccgtcattattctgtacacgaggttttcagccctcaaggagacggagcgccagcagaagaagattcttgaagagacggaaaacacccttgcagcgtttctgcttgagctgaaagaagaaaatgaaagactcgaagacgcaaaaagccgtcaagcgccggacgcagaagacgccgaaccccggccggaaccgaaagaagagcctgatattccggaccacatggaaaagctcatcagtgcaacggaacgggctgaaagtgacgaaaacagcggcgcgcattcgtttgaagaacgtgtttcagaattatatgaacaagggctcacccccgcggaaattgccaaacggatgcagagcggaaagacagaaatcgagctgtttttaaaatttcgcggcaaagctgtaaaggattcttgattgtcgcataaagctgtgttatattatttcttggtgttaaatacacacgcttaacgatttatgcagagggtgctgcaaacggcagttctgcacaaaaatgacctaagcggaggaaaaaaaccattttattaggaggaaatcacatgtcagttatttctatgaaacaattgcttgaagctggtgttcacttcggccaccaaacacgccgctggaacccaaaaatgaagcgttacattttcacggagcgtaacggaatctacatcattgaccttcaaaaaacagtgaaaaaagtagaggaagcttacaacttcacgaaaaaccttgctgctgaaggcggaaaaatccttttcgtcggcacaaaaaaacaagctcaggattctgttaaagaagaagctgtacgctctggcatgtactatgtcaaccaacgctggttgggcggtacactgacaaacttcgaaacaatccaaaaacgcattaagcgtctgaaagacatcgagaaaatgcaagaaaacggtacatttgaagtacttccgaaaaaagaagttgttcaattgaaaaaagaattagagcgtcttgaaaaattcctcggcggaattaaagacatgaaggatcttcctgatgcattattcatcatcgatcctcgcaaagagcgcatcgctgttgcggaagctcgcaaattgaacattcctatcatcggaatcgtagatacaaactgtgatcctgatgaaattgatgtcgtaatccctgcaaacgatgacgcaatccgcgctgtcaaacttcttacttctaaaatggcagatgctattcttgaagcgaagcaaggcgaagaagaagcggaagctgctgaagagactgcacctgaaacagaaacgacaactgcgtaacctaatcaaaaggtgatagaagggactgccttttatcaccttttttcaagaaaaatgtatctatacatatcttgtttacacatataaggaggaattcaaatggctattactgcacagcaggtaaaagaactgcgtcaaaaaacaggcgctggtatgatggactgtaaaaaagcattgactgaaactgacggagatatggacaaagcaatcgaccttctgagagaaaaaggaattgcgaaagcggctaaaaaagctgaccgtatcgctgctgaaggttctactcttattaaaactgacggcaacaaaggcgttatcttagaagtaaactctgaaactgatttcgttgcgaaaaacgaaggcttcaaagagcttctgaacacgcttgctgaccaccttcttgcaaacgctcctgctgatcttgaagaagcaatgggtcaaaagatggaaaacggttctactgttgaagaatacatcactagcaacgttgctaaaatcggagagaaaatcactcttcgccgttttgctgttattacaaaagaagacagcgaagcgttcggtgcttaccttcacatgggaggccgcatcggcgtattatccgttcttagcggaacaactgacgaagatcttgcaaaagacatcgcgatgcatgttgcagcggtaaatcctcgttacatttcccgcgaccaagtgtctgaagaagaagcaaaccatgagcgtcagatcctgactcagcaagctcttcaagaaggcaaaccggaaaacatcgtagctaaaatggttgaaggccgtctgaacaaattcttcgaagaaatttgcttattagaccaagctttcgttaaaaacccagacgaaaaagtgaaacaagttgtggctgcgaaaaacgcatctgttaaaacttacgtccgctacgaagttggagaaggtattgaaaaacgccaagaaaactttgctgaagaagttatgaaccaagtgaaaaaataatggcggaaagccttggcgaatctttcgcggcttttcaggcagtataggggacactacttgtgttccctatttttaaaactatatttacaaacctttttttctcttgcataataggaaacggcaatgtttacacttggaggttattatggaaaaaccaaaatacaatcgtatcgttttaaagcttagcggagaagcattggcaggagagcagggaaatggcattaatccgactgtcatccaatccatcgctaaacaggtaaaagaaatcgctgagcttgacgtcgaagtggccgtagtcgtaggcggcggcaacttatggcgcggaaaaacaggcagtgacttaggaatggaccgtgcgacggccgattatatgggcatgcttgctactgtcatgaactcacttgccctgcaggacagcctggaaacgctcggaattcagtccagagtgcagacatcaattgaaatgcgtcaggtcgctgagccttacatcagaagaaaagccatccgccacctggagaaaaaacgcgttgttatttttgccgcgggaacaggaaacccttatttctctacggacacaaccgcagcgctgcgtgccgctgaaatcgaagcggacgtgatcttaatggcgaaaaataatgtcgacggtgtgtataatgctgatccgagaaaagatgagtcagccgttaaatacgaaaaattatcttatctcgatgtgttaaaagacgggctggaagtcatggattctacggcttcttcactatgtatggataatgatattccgctgatcgtcttttctattatggaagaaggaaatattaagcgtgccgtaaccggcgaatcaatcggaacgatcgtaagggggaaataacgttgtcaaacgaagtattaacacaaacaaaagaacgcatggaaaaagcggttgccgcttattcacgcgaattggcgtcagtccgcgcaggacgtgccaacccatctctattggataaagtgacagtagaatactacggtgcccaaacacctttaaaccagctgtcttccatcaatgtgcctgaagcgcgtatgcttgttgtcacaccgtatgacaaaacggcaatcggcgatattgaaaaagcgatcctgaaagctgatcttggcgtaacgccgacaagtgacggcacaattatccgtatcgcgatcccggctttgacggaagaaagacgtaaagaacttgtcaaagtcgtgaaaaaatacgcggaagaagcgaaagtagcagtccgtaatgtccgccgtgacagcaacgatgacctcaaaaaacttgagaaaaacggagacattacagaagacgagcttcgtgcttccagtgaagacgttcaaaagctgacagacgaatatgtgtcaaaaattgacagtgtcacaaaggacaaagaaaaagaaatcatggaagtttaatgaaaaactatgtacaatagataatgtgaaaagaccctctcatgtttacagggggtttttttgttaatactgttgattacattgatcatcagcaacgcaacctttttgggtgacggaggaatctcatgctcaacatactcaaaaattggaagaatcagcagaatgcggcttccaacttagaacggtatacaaaagaagacatactgaagggtgaaattcccgcacacattgccattattatggacggaaacggacgctgggcgaagaagcgctcactccctcggattgcaggacatcatgaaggaatgaaagtggtaaaaagggtgacaaagctcgcaagtcagctcggcgttaaagttctgactctttatgcgttttcaacggagaactggaagcgcccgaagatggaagtcgactttttgatgaagcttccggaagagttcctgaatacgtatcttcctgaattgatagaggaaaatgtacaggtgaaaattatcggagatgaatccgcgctcccttctcatacgtacagggcgattgagaaagccgtaaaagatacagaacaaaatgacgggatgattctcaatttcgctttgaactacggcggacgcacggaaatcgtcaatgcggcaaaagcactggccgaacaggtgaaaagcggcacgctgaatatcgaagacattgatgaagcgctcttttccgggcatttaatgacagaatcaatccaggacccggagctgctcatcagaacgagcggagaaatcagattgagcaactttatgctttggcaggtggcttacagtgaatttgtttttacagatgtcctgtggcccgattttaaagaagatcactttctgcaggcagtgggagaatttcagcagcggggccggaggtttggcggaatttagaggatggtggaaatgaaacaaagattgttaacgggtgttctggcagcggcactatttttatttttggttattttcggaggattgccgttcaccgtatttgtttatgtgatgggcagtatagcgctttttgagcttttgcggatgaaaaagctcaagtttttttcttttccgggtctgatcagcctcctgttattatggctgtatatgatgccggacaaatatcatttttttgacgcgaaaatggaagtaacgattttcgccgttttgatattgctcagctatacggtgcttgtgaaaaacacctttacgtttgatgaagtcgggtttatcgtcctagcgacggtatatatcggactgtgttttcattattttatcgaaatcagaaacattgaaacaaacgggcttttgtatattttttatgcctgcgttgtcatatggtcaacggattcgggcgcatattttgtaggaaagtcgctcggaaagcggaagctgtggcctgaaatcagtcctaacaaaacggtggaagggtttctcggcggtattgccatcgcccttattttcacggctgtttttcagctgtttgccggtcttccgatttcatacccggttcttttggtcatcacacttgttctgtctgttttcggacagatcggggatttggtggaatcagcgctgaaacggcactatgatgtgaaggattcggggaaaatccttccggggcatggcggcattttagatcgatttgacagctttttgtttgtcatgccgttcttgtactttctgcttgcgcttttttcatgagaaaggctaatatgaaaataagaccgatctggacgcatagaatgggagtggcattttgaagaatatttgtcttttaggagcaacgggatcaataggggagcagacattggatgtattgcgcatgcatgaagaccaattccgtctcgtctcgatgactttcggtaaaaacgccgaaaaagcaatcccgttgatcagaacgtttcagccgaaatatgtagcagtcggcgacatggatacataccaaaaagtgaaagaagcgtctttttctcatgaatgtcaaatcggcatcggagaagaaggcctgattgaagcggcagtcatggacgaagtggatatcgtggtcaatgcgctgcttggaagcgtcggtttaatcccgactttgaaagcgattgaacagaaaaaaacaattgcgcttgcaaataaggaaactctcgtcactgccgggcatatagtgaaaggacacgcaaaacgatacggtgttcctcttcttccggtcgacagcgaacattccgctatttttcaggcgctgcaaggcgaacagagcaaaaatatcgagcgcctgatcattacggcatccggcggcagtttcagagataaaacgcggcaggagcttgagtctgtaacgattgccgacgcccttaaccacccgaactggtcgatgggcgcaaaaattacgattgactcggctacaatgatgaataaaggacttgaagttattgaggcgcattggctgtttgacattccgtatgaacagattgacgttgtattacataaggagagcatcattcattcgatggttgaatttcacgacagaagcgtcatcgcccagctcggaaatccggacatgagggtgccgattcaatatgcgctgacatatccggaccggctgcctctgcctgaaacaaaaaggcttgaattatgggagatcggaagccttcattttgcgaaagctgactttgaaaggttccgctgcttacaatttgcctttgaatcaggtaaaatagggggaacgatgccgacggttttaaatgcggccaacgaagaagccgttgccgcttttcttgccggacggatttcattcttatcgattgaggacctgattgaaaaagcactggaccgccacagcgtaattcaggatccgagtcttgcggatatccaagaagtggacaaagacacccggggatacgttaattcaatactcacataaggtggtatgttcgtgaatacagttatcgcgtttattattattttcggaacgctcgtttttttccatgagctggggcatttattgctcgcccaaagagcgggaatcctttgccgtgaatttgcgatcggcttcggccctaaaatcttttcatttaaaaagaatgaaaccgtgtatacgatcagactccttccggtcggcgggttcgtccgcatggccggtgaagacccggagatgatcgaagtcaaacccggttataccgtcggacttctttttaataaagatgacgaagtggaaaaagtcatcattaatcaaaaggaaaaatatcccgacgctttaattatcgaggtggagacggctgatcttgagcacgaaatgaagattaccgggtacgagcaggggaaagaagatgaactggcgggctttactgtcagtcagacctctttttttatcgtagacggagaagaagtgcagattgcgccttacaatcgacaattcgggtctaaacccgtatggaagcggattaaggcgattgctgccggtccgataatgaacttcatcttagcgtatgtcattctcgtcatgcttggattcattcaaggcgtgccttcgaatcagcctgagctcgggaagctgacagacaatggacgcgcagcggctgccggtttaaaagaaggcgactatatccagagcattaacggtgaaaaaatgaggtcatggaccgacatcgtgacagcggtaaaagaaaatcccgggaaaaaaatcgatgtcgccgtcaaacgggacggcaaatcgtttcatatctcggttacacctgaagctgtaaaagatgaaaataaaaaaacaatcggccgcttcggctcttatgcgccgactgaaaaaggcgcgcttgcagcgatcgcctacggcgcgacatctaccgttgatgtcacaaaagcgattctgaccaatctgggcaaaattgtgacaggccagtttaagcttgatatgctttcgggtcctgtcggcatttatgatatgacggatcaagttgcaaaaaccggcatcatcaacttattgcggtttgcggcgtttttaagcatcaacctgggaatcgtcaacctgctgccgataccggcgcttgacggcgggcggctgctgtttttattcattgaagcaatccgcggcaagccgataaaccgtgacaaggaagcatttgtcgtatttatcggcgtagctttcttaatgcttcttatgctggttgtcacatggaacgatatccagcgtttattcttataattgactagtaaaaaatcagaggtgcgaagacatgagacaaagtttgacgcttattccgaccctgagagaagtgccggctgatgctgaagcaaaaagccataagcttctgctgagagcgggatttatcagacaaaatacgagcggggtttacagctacatgcccctggcttacagggtcattcaaaacattcagaagatcgtgcgtgaagaaatggaaaaaatcaacgcggtggaaatgctgatgccggcccttcagcaggctgaaacatggcaggaatcaggcagatggtatacgtacgggcctgaattaatgcgtctgaaagaccgccacggccgtgaatttgctttaggcgcgacacatgaagaagtcattacttctctcgtgcgcgatgaggtgaaatcttataagcgtctgccgctcactctttaccagatccagtctaaattcagagatgaaaaacgcccgcgtttcgggttattgcgcggacgcgaattcatcatgaaagatgcgtattctttccatgcttctgaagaaagtctggaggaaacgtaccaaaacatgtacggcgcatacagcagcattttcgcacgctgtgaattaaacgtccgtcccgttattgccgactcaggcgcgatgggcggaaaagatacgcatgaatttatggctctttctgaaataggggaagataccatcgcttattccgatggatcctcttacgcagccaatacagaaatggcggaagttgtcatgaacagcgagccgtcagatgaaacacccgaggcattggagaaaattgatacgccgaatgtcaaaagcattgaagagctcgcttcgttcttgcagatcgagccgagcgcctgcatcaaatcaatgctgtttaaagctgatgaccgatttgttctcgtgttagtgagaggcgatcatgaggtcaatgacgtgaaagtgaaaaaccttctgaacgcggaagtggttgagcttgcgtctcatgaagaagtagcggagaaacttggcacggagccgggatttgcggggccgatcggcgctgccggcgacattgagatttatgccgaccaagccgtgaaagtaatggtaaacgctgttagcggcgcgaatgaaagagaccgtcattaccgaaacgtaaacatcgaacgtgatgcgtctgtaaaagcgtatgccgatcttcgaatcattcaggaaggcgatccgtcacctgacggaaaaggcacgatccgtttcgctgaagggattgaggtcggacaagtctttaaactcggcacgcgttactctgaagcgatgaatgcgacataccttgatgaaaacgggcgtgcgcagccgatgctgatgggatgttacggaatcggcgtgtccagaacgctttcagccatcgctgaacagcatcacgacgaaaaaggcttgatctggccgaaaagcgttgctccgtatgatcttcatattttggcgctgaatatgaaaaacgaagcgcaaaaagagcttgctgaacagctttacggcaaattccaggcggaaggttatgaggtattatacgatgaccgcgctgaacgcgcaggcgtgaagtttgctgattctgatctgatcggccttccgatccgcatcactgtcggaaaacgtgccgacgaaggcatcgtagaagtgaaaatccgcaaaaccggtgaatctgccgaagtttcagtggatgagctttctgaatttatcaagacgaagtaatcaccataacgaatcacacaaaatcatgttaaaatagagaaaaaagaaggtacctcatcacctgcggaggtaccttcacttatgatgttttaagggagggatactgtctgaatggaacagttatcagtaaacagaagacagtttcagattcttctgcagcagcttaatatgacagatgataccttcatgacatactttgaagacggagagattgataaactgacaatccataaagcagaaaaagcctggcatttccaatttcgctttaaggctcttttgccgtatcaaatatatgactcattcatgatgaggttaacacaatcgtttgctcacatcgcccgtgtcacatcgtctgttcaggtcattgaccccacagtgacagaggagcttgtacaggattattggacacgctgtattgaagagcttgaaggaacctcgccgccgatggtggctcttttgaatcagcagaagccgaagctcaagggaaacaagctgatcgtgaaaacaaaaacagatacagaagcatctgcgctcaaaaataaatacagcgcactgattcagcacagctatcgccaattcggctttccggaactgcagctggataccgaaattttcgtatctgaccaagaagtccagaaattccgcgagcaaaagcttgctgaagatcaggagcgggcgatgcaggcgcttatcgagatggagaagaaggaaaaagagggcgatgaggatcaggcaccgtccggaccgcttgtcatcggctatcaaattaaagagaacgaagaaatccggacgcttgacagcatcatggatgaagaaagaagaattacggtgcaggggtttgtgtttgatgctgaaacacgcgagctgaaaagcggacgcacgctctgcattttcaaaatcacggactatacaaacagcattttagtaaaaatgttcgccagagaaaaagaagacgccgctttgatgaaaacgctgaaaaaaggcatgtgggtgaaggcgcggggaagcattcaaaacgatacattcgtcagagacctcgtcatgattgcaaatgacgtgaatgaaataaaagccaaaacccgtgaagacaccgctcctgaaggcgaaaaacgggttgagcttcatctgcattctccgatgagccaaatggatgctgtaacgggcatcggaaagcttgtcgaacaggcgaaaaaatggggacatgaagcgattgcgttaactgatcatgccgttgtgcagtctttcccggatgcctattccgccgcgaaaaaacacggcattaaaatgatttacggaatggaagccaatatcgtagatgatggcgttccgatcgcatacaatccagctcaccgtctcctggaagaagacacatacgtcgtctttgacgttgaaacgacaggtctgtccgcagtgtatgacacgatcattgagcttgccgcagtcaaaataagaggcggagaaatcatcgataaattcgaagcgttcgccaatccgcaccatccgctgtcagcaacgacgatagagcttaccgggattacggacgacatggtccgcgacgctcccgatgtcgttgacgtcgtccgggattttaaagaatggatcggcgatgacgtgcttgtggctcataacgccagctttgatatgggatttttaaatgtggcgtacaagcgtcttttgaaaacggaaaaagcgaaaaatccggtcattgatacgctggaactcgcgcgtttcctgtatcctgagtttaaaaatcaccgcttaaatacgttatgtaagaagtttgatatcgaattaacccagcatcaccgagcggtctttgacgctgaagcaacgggctacctgctgttgaaaatgctcaaagatgccgctgaaaaagacattttttatcatgatcagctgaatgagaatatgggacaatccaatgcttatcaaagatcaagaccttatcacgctacattgcttgccgtaaatgagaccggccttaaaaatctgtttaagctcgtgtccatttctcatattcaatatttctacagagtgccgcgcattccgaggtcgcagcttaataaatacagagaaggtctgttaatcggctctgcctgtgacaggggagaggtctttgaaggcatgatgcaaaaatctcctgaagaggttgaagatatcgcatccttctatgactatcttgaagtgcagccgccggaagtatacagacaccttctgcagcttgagctcgtccgggatgaaaaagcgctgaaagaaatcatcgccaacattacgaagctcggagaaaaattgaataagccggtcgtggctacgggaaatgtccactatttaaacgatgaggataaaatttaccggaagatcttaatatcttcccaaggcggcgccaacccgttaaacagacacgaactgcctaaagtgcacttcagaacgacagatgaaatgctggaggctttctccttcctcggtgcggaaaaagcgaaagaaatcgtggttgacaatacgcagaaagtcgcttcgatgatcgatgagatcaaaccgatcaaagacgatctgtacacgccgaaaattgacggggctgatgaagaaatccgtgaaatgagctatcagcgcgccaaaagcatttacggtgaagagcttcctgaaattgtggaagcgagaatagaaaaagaattaaaaagcatcatcggccatggattcgccgttatttatctcatctctcataagcttgtaaaacggtctttggatgacggttatctcgtcggctcccgggggtccgtcggttcatcgcttgtggcgaccttaacggaaatcactgaagtgaacccgctcgctccgcactatgtgtgcccgagctgccgatattccgaattctttaatgacggatcagtcggttccggttttgaccttccggataaaacctgcccgtcttgcggcacgcctttgaaaaaggacggacatgatatcccgtttgaaacgttcttaggctttaaaggtgacaaagtacccgatatcgacttgaacttctcaggtgagtatcagccgcatgcccataactacacgaaagtattgttcggtgaagataacgtgtatcgcgcgggaacgatcggcaccgtcgcggaaaagacggcttacggatatgtgaaaggctatgcgggcgatcacaacctacacatgcgcggcgcagagatcgaccgtctggtgcaaggctgcaccggcgttaagagaacgaccggccagcacccgggggggattatcgttgtcccggattacatggatatttacgatttttccccgatacaattcccggcagatgcgacggggtctgaatggaaaacgactcattttgacttccactccattcatgacaacctgctgaagcttgatatattggggcacgatgatccgacagtcatccggatgcttcaggatttaagcggaattgatccgaagacgattccgacagatgatccggaagttatgaagattttccaaggtacagaatcgctaggcgtcactgaagagcagatcggctgtaaaacggggacgctcggcattcctgaattcgggacgcgatttgtgcggcagatgcttgaggatacgaagccgacgacgttctccgagcttgtccagatttccgggctttcccacggaacggacgtatggctcggcaatgcgcaggaactgatacacaacaatacgtgtgaactgagcgaagtgatcggctgccgtgatgacattatggtttacttgatctatcagggccttgagccttcactggcctttaaaatcatggaattcgtccgtaaaggcaaaggcctgacgccggaatgggaagaagaaatgaaaaagaacaatgtgccgaactggtatattgattcatgcaaaaaaatcaaatacatgttcccgaaagcccacgccgccgcatacgtgctgatggcggtgcggattgcatactttaaagtgcatcacgcgcttttatattatgctgcgtattttaccgtccgcgcagatgactttgacattgatacaatgattaaaggctcgaccgccatcagagcggtgatggatgatatcagctctaaagggcttgatgcttcgccgaaggagaaaaacctccttaccgtgttagagcttgcgcttgaaatgtgtgagcgcggctattccttccagaaggtcgatctataccgttcgagcgcttcggaatttatcattgacggcgacagtctcatcccgccgttcaactcaattccgggactcggaaccaacgccgctctcaatattgtgaaagcgcgggaagaaggggagttcctttcaaaagaagatcttcaaaaacgcggaaaagtgtcaaaaaccattttagagtatttagaccgtcacggctgtcttgagtcccttccggaccaaaatcagctgtctctgttttaagctttgtgcacagccgccgagcggagtttgatttgcattaaatatatggttatggtatagttttattggaaatgctaacgattaccgaggcaaagagtggggaaacccgctcttttgtattgaacaggcaattttgcctcgacatgtccatcgttttctcaatgcccctgctcttttgaagcagggtttttatgcagaggaacggctgatatgatatcgacagcacaaggaggaaaaacatgagcaaaaaagtgactgataccgttcaagaaatggctcagcccatactggatgaccttcaccttgaactcgtagacattgaatttgtcaaagagggtcaaaactggttccttcgcgtgtttattgattccgagaacggtgttgatattgaggagtgcgccaaagtcagcgaagcgttaagcgaaaagctggatgaggccgatccgatcacccagaactactttcttgaagtatcttctcctggagccgagcgtccattaaagaaaaaagccgacttcgaaaaatcactgggcaaaaatgtgtacatgaaaacgtacgaaccgattgacggtttaaaagtgtttgaaggcaaattggctgaatttgatggacaaactgttacaatagagatgacggtcaaaacaagaaagaaacgggtcaatattccgtatgaaaaaatagctaacgcgagattagctgtaacattttaatgaatgaagtattagtgtttaaggggggagaccgctaacatgagcagtgaactattagatgctctcactattcttgaaaaagaaaaaggcatcagtaaagacattatcatcgaagcaattgaagctgccttaatttccgcgtataagcgaaattttaaccaggcgcaaaacgtacgggtcgatctgaaccgtgagacgggcacgatccgcgtgttcgcaagaaaggatgtcgtagacgaggtatacgattcaagacttgaaatctcgcttgacgacgcccagcacatccatccgaactaccttgtcggagatgtcgttgaaatagaagtaacgccgaaagacttcggccgcattgctgcgcagacggcgaaacaagtggtgacgcagcgtgtccgtgaagctgagcgcggcgtgatttactcagaatttatcgatcgtgaagaagacatcatgacgggaattgtacagcgcttagacagcaagtttatttacgtgtctctcggcaagattgaagcgctgctgcccgtcaatgaacaaatgccgaatgagagctataaaccgcacgatcggattaaagtatttatcacaaaagtcgaaaaaacgacaaaagggccgcagatctatgtatcaagaacgcatcctggcctgttgaagcgtctttttgaaatcgaagtgccggaaatttatgacggaacggtcgaactgaaatccgttgccagagaagcgggcgaccgctctaaaatctccgtccgcactgatgaccctgacgttgatccggtcggttcatgcgttggtcctaaaggccagcgggtgcaggcgatcgtcaatgaactgaaaggcgaaaaaattgatatcgtcaactggtctgatgatccggttgaatttgttgccaatgcgctcagcccgtctaaagtgctggatgtcatcgtcagcgaagaagaaaaagccacgactgtcatcgttcctgattaccagctttctctggcaatcggaaaaagagggcaaaacgcccgcttagccgcgaaactgacaggctggaaaatcgatatcaaaagtgaaacggatgcaagagaccttggcatctatccgagagagcatgaagaagatgacgatttagagccgctctttatggagcctgaaacagccgaatcggatgaataagaggtgactttaggtgaataagcgaaaaaaaattcctctgcgcaaatgcgtggtaacgggggaaatgaagcctaaaaaggaactgatccgaattgtccgttctaaagaaggagagatttcagtcgatccgaccggaaagaagaacgggcggggtgcctatatcacccttgagaaagaatgcatcttagctgcgaaaaagaaaaacacattgcaaaatcaatttcaatcacaaatcgatgaccagattttcgaagaattgctggaactggcggaaaaggtgaaaaaataacatgtctggaatggaatggtttcccttgctgggtctggccaatcgagctcgtaaggtcgtgtcgggcgaggacttggttataaaagaaattagaaatgcgcgtgcaaaacttgttctgctgacagaagatgcatctgcgaatactgcaaaaaaagtatccgataaatgcaattattataaagtgccttataaaaaagtcgaaagccgcgcggatctcggccgctctatcggcaaggaatcacgtgtcgttgtcgccgtcactgaccaaggttttgcgaataagctgatcagcttgctcgattaatatttttgggggtgaacgaatggctaaaatgagagtttacgaatatgcaaaagccatcaatgtttcaagcaaggaaattttgactgcgctgaaaaacatggatatagtagtaaataaccatatggcaatgcttgaagaaaagaccattaagcagcttgatgcgaaatttaaaaaaggcggcgccggcgttacatctcagaagcctgcggaaacgaacaaaaacaagccgcaagggattaatcagcagcctgctgggaatcaaccaaacaaaattcgagacggaaagaagaatgacgtgcagaataatcaatttaacaaaaacaagaagaataacaacaacaacaaaaacaaaaacaaacgcaatcataacaacaaaaatcagtatcagcaaaaaccgctgaagccgaaaaaagagcttcctgagaaaattacgttttccggctctttaacagtcggagctttagccgaggaactgggcaaagagccgtctgaactcattaaaaaactgatgcttctgggcgtaatggctaccattaaccaggagcttgacaaagacacaatcgaactgatcgcatctgaatacggtgtagaaacagaagaagtgattgtgcttgaagaaactgagcttgaaaaatatgaagaggctgacaaagaagaagatcttcaaatccgtccgcctgtcgtgacgatcatgggccacgttgaccacgggaaaacgaccctccttgacagcatcagaaaaacaaaagttgttgaaggagaagccggcggaatcacccagcatatcggggcttaccagatcgaagaaaacggcaaaaaaatcacgttcttagatactccgggacacgcggcgtttacaacaatgcgggcgcgcggtgcggaagtaactgatattaccattttagtcgtagcggccgatgacggcgttatgccgcagacagtcgaagccatcaaccatgcgaaagcggctgaggttccgattatcgttgccgtgaataaagtggataaagaaagcgcgaaccctgaccgtgtcatgcaggagctgactgaatacggactcgttcctgaagcatggggaggagaaacgattttcgttcctctgtccgctcttacaggcaagggaattgacgagcttgtcgaaatgattctgcttgtcagtgaagtggaagagctgaaagccaatccgaaccgtcaggcaaaaggaacggttattgaagctgagctcgataaaggaagaggatctgtcgcgacacttctcgttcaaacgggaacattgaatgtcggagatccgatcgttgtcggaaatacattcggccgcgtgcgggccatggttaatgatctcggccgccgcgtgaaaacagccggaccgtctacacctgtagaaatcacgggcttaaacgacgtaccgcaggctggcgatcaattcctcgtctttaaagacgaaaaaacagcccgttctgtcggtgaagcacgcgcttctaagcaactggaagaacagcgcagcgacaaagcgaagctgagcctcgatgatctgtttgaacaaattaaacaaggcgatgtcaaagacatcaatttaatcgtaaaagctgacgttcaaggttcagccgaagcgttaacagccgctcttcaaaaaattgaagtagaaggcgtaaaagtgaaaatcattcacacaggcgtcggtgcgattacggaatcagacatcattctcgcatctgcttcaaatgcaatcgttatcgggtttaatgtgcgcccagacggaaatgctaagagcacggctgaagctgaaaatgtagatatccgtcttcaccgtatcatttacaaagtcatcgaagaaattgaagcggcgatgaaaggaatgcttgatcctgaatacgaagaaaaagtcatcggccaggttgaagtgcgccaaacattcaaagtgtcgaaaatcggcacgattgccggcggatatgtaacagacggccacattacacgtgacagcggactccgcctgatccgtgacggcgtggtcatcttcgaaggggaagtagacgttttgaaacgcttcaaagatgatgtgaaagaagtttcacaaggatatgaatgtggtattacaattaagaaatacaatgacattcgcgaaggcgacatccttgaagcgtatgtcatgcaggaaatcgaaagaaagtgatcggatttgcggaatgtgaatgcatcatttatgatgcgggatcattaaaggagaaacgagccgttctgaagcggattataacgagggttcagaataagttcaacgtgtcggccgcagaaatcggctatcaggacacttggcagcggaccagcttcggaatcgccgtcgtctcctcctctcacgttcaggcggaaaaggagatccagcgcgtactcgcgtttattgactcctttcccgaaatagaacggacgatcactagaacagagtggttttaacttagaggtgattgaattgagtatgagagcaaaccgtgtcggcgagcagatgaaaaaagagctcggggatattatcagccgaaagctgaaagacccgagaatcggatttctcactgtaacagacgtacgtgtttcaggtgatttacaaatagcgaaggtgtatatctccgttctcggcggagataaaaagaaagaggaggcgctgaaagggcttgagaaagcgaaaggatttatccgttccgaaatcggcagccgaatcagactccgcaaaacgcctgagcttgaatttgaatttgatgaatcaattgagtacggcaaccgtattgaaacattgattcacgaactgcattcagataaaccgtctgaataacaaggaaagaggatgggcgagtgtcgtctgtcctcttttctgcgttttacgggatacaattgataacaaaggagcgaaagacatatggttaacggagttctccttttacataaaccggtcggcatgacttctcacgactgtgtaatgaaaataagaaaactgttaaaaacaaagaaagtcgggcatacgggaacgcttgatccggaagtgtcaggcgtactgccgatctgtgtcggacgggctacaaagatcgttgagtacgtcaccgacaagtcaaaaacgtacgatgctgagatcactctcggcttctccacatcgaccgaagaccagactggagaaacggtcagcgtaaaacctgtcaaggagccgctgaaagaagcggatatcaaagccgttttagacgaactgaagggaccgcaggagcaagtgccgccgatgtattccgctgtaaaggtcaacggaaaaaagctctatgaatacgccagagccggtattgaagtggagcggccgaagcggaatatcacgattgaagatatcgcgctcacttcccctgtcacttataaagaagacacagcatcattccgctttacagtcacgtgctcaaagggcacttacgtgagaacattggcggtgacaatcggtgaaaaactcggctatcccgcgcatatgtcgcatctcatccgcaccgcttccggcgatttcagccttgatgagtgtttcacgtttgaggaacttgaacagcaggtttcagacggaacggttgcagagcatgccgtgccgattgaaagagcgctcaatcatttgccgaaatgggtcataagtgatacattagctaagaaagctgaaaacgggtcggtgtttgacatcccggcggaattttctgcaatgacagctgacgcccgtatagcggtctgtactgaagacggagaatgtgtggccatttatatgccgcatccttcaaaaaaaggactgctgaaaccggctaaagtgctcatgcaaaaaagcgaacaataagaaaaaaggtgaccgttctgtgaagacgatacatatttctcatccgcatcatttacaaaaagaagagcagccggcgtctgtcatggcgctcggctactttgacggcgttcatttgggacaccggaaagtaatcggaacagccagacaaattgccgaagaaaaaggcctgtcgctggccgttatgacgtttcatccccacccttcccatgtgttgggcagggacaaagagccaaaggatctgattacgccgcttgaagataaaatcagccagatcgggcgtttaggcgctgatgtgctgtatgtcgtaaagtttgatgaagcgtttgcgtctctgtctccaaaacagtttgccgaggagtatattttagggttaaacgcgcggcacgctgtgggaggcttcgatttcacgtacggaaaatacggaaaaggcacgatggagacgctgccggacgatttaaacggcaaggccggatgcacgactgtcgagaaactgaccgagcaggacagaaagatcagctctacttatatccggtcagcgttgcaggatggtgacgttgaacttgcgcacactcttctcggccagccgtattttatccggggcactgtgattcacggagacaaaagaggccgcaccatcggttttccgaccgcgaatgtcggcctgcacaacagctatatcgtgccgccgacaggcgtgtatgcagtgaaagccgaaataaaaggcgaggtgtatgaaggcgtctgcaacatcggctacaaaccgaccttttatgaaaagcgtcccgatcagccgtcaattgaagtgcatttgtttaattttcagcaggatgtatacggagaagacgttaaaatcgagtggtacaaacgaattcgaagcgaacggaagtttaacggcatcgatgaactgacggctcagatcgggaaagacaaacaagaagcgatccgttttttcagcaaataacggaaaaaacatcaaaagtacacaaattttcttctaaaagatttgcatatgggcgcgatttttagtatcatatgtttcgtagtcttaaaaccattgcttggcaatccgaagtcaccgacggttgctaggtaactggggctaattatgatatggaggtgaaacaggatggcaattactcaagagcgtaaaaatcaactcatcagtgagttcaaaacacacgaatctgatactggatctccagaagttcagatcgctatcctaacagactcaattaacaacttgaacgagcatttgcgtactcacaagaaagatcaccactcacgtcgcggtcttcttaaaatggtaggtaaacgtcgtaatcttcttacgtatctgcgtaataaagacgtaactcgttaccgtgagttaattaacaaactaggcttacgtcgataatcgtaaaaagcgggaggattcccgcttttttatcgtattaaagcgaaaaaaataatgataaaaaaacaatgaaatccttttacatactactttgacattgatatgttcaattcatttcgttcataataggagtaattgattatttcacacattaagagaggagctcgtaatcgaatgggacaagagaaacatgtctttaccatagattgggccggcagacagcttacagtagaagccggccagcttgccaaacaggcaaacggcgctgtcatggtccgctacggcgatactgcagtgctcagcacagcaaccgcatcaaaagaaccgaaaccgctagattttttcccgcttaccgttaactatgaagaaagattatacgcagtaggtaaaattccgggcggttttattaaaagagaaggccgtccaagtgaaaaggccgttttagccagccgtctgatcgaccgtccgatccgcccgcttttcgcagacggattccgtaacgaagtacaggtcatcagcattgtcatgagtgttgatcaggactgctcatctgaaatggctgcaatgttcggttcatcactcgctctttgcgtttccgatatcccgtttgaaggcccgatcgcgggtgtgacggtaggccgcattgacgggaaattcgttatcaatccgacggttgaccagcttgaaaaaagtgatatcaacctcatcgttgcaggcacaaaagacgccatcaacatggtggaagccggagcagatgaagttcctgaagaaatcatgcttgaggcgattatgttcggtcacgaagaaattaagcgcctgatcgcattccaagaagaaatcgtcgcagcagtcggcaaagaaaaaacagaaatcgaactgtatgaaattgacgaagagctcagcgaaaaagtaaaaagccttgcggagccggatcttctcagcgccattcaggttcacgaaaaacatgctcgcgaagacgcgatcaatgaagtgaaaaatgcagttgtcgcgaaattcgaagaagaagagcatgatgaagatacgattaaaaaagtgaaacagacactgtctaaactcgtgaaaaacgaagtgcgccgtttgatcacagaagaaaaagtccgtccggacggccgcggcgttgatcaaatccgcccgctttcttcagaagtcggccttctgccgagaacgcatggctccgggctgtttacgagaggacagacgcaggcgctcagcgtttgtacattaggcgcccttggggacgttcagattcttgacggtttaggcgtggaagaatcaaaacgttttatgcatcattataacttcccgcagttcagcgtaggggagacaggcccgatgcgcggaccgggacgccgtgagatcggtcacggcgctcttggagagcgtgcgcttgagccggtcattccgaatgaaaaagacttcccgtatacggtccgcctcgtatccgaagtgcttgaatcaaacggttccacttcacaggccagcatttgcgcgagcacgcttgccatgatggacgcaggtgttccgattaaagcccctgttgcaggtatcgcgatgggacttgtgaaatcaggcgagtactatacggtattaacggatattcaagggatggaagacgccctcggtgacatggactttaaagtagccggcacggaaaaaggcgtgacagcgctgcaaatggacattaaaattgaaggcctttcaagagaaattcttgaagaagcgcttcagcaggcgaaaaaaggaagaatggaaatcttgaacagcatgctcagcacgcttggtgaatcaagaaaagaactttctcaatatgcgccgaaaattttaacgatgaacattaatccggataaaatccgtgacgttatcggaccgagcggtaaacaaatcaacaaaatcattgaagataccggtgttaaaattgacattgaacaagacggcaccatctttatttcttctactgatgaaagcagcaaccaaaaagcgaaaaaaatcatcgaagatcttgtcagagaagtcgaagtcggccagctttacctcggtaaagtcaaacggattgagaaattcggcgctttcgttgaaatcttcagcggaaaagacggtctcgttcacatctctgaactagcgctcgaacgggtcggcaaggttgaggatgttgtgaaaatcggtgacgaaatccttgtgaaggtaaccgaaattgacaaacagggacgagtgaatctgtcgcgtaaagcagtgctgcgcgaagagaaagaaaaagaacaggaacaacaacaatcttaaatgaaaacctaacaaggagcctgggagacccggcttctttattttgagaaagacaacagacgggttctaccttgtcctcctcatacataatgtgtgatgaggagggaaggacatgttgaaaaaattcgtgccgtttgccgtttttttatttcttttttttgtttcgtttgaaatgttaaaaaatccgtatacagttgattacatagacgcaatgaaaaaagacgctgtaactgtgtcagcatcaaaagatccgctctatgaagaattactgcaaaaagcgtcagagtatgaagtgaagccgcaagacgcgcggattgataaaatatggaagagtataccgggatataacggtttaaaagtcaatgtggaaaaatcctataagcaaatgaaaaaggacggagaatttcacgaagacggccttgtctatgagcaggtgaaaccgaaagtccatcttgattctctcgcgcccgaacccatttataaaggaaatcccgacaaaccgatggtcgctttcctgataaatgtcgcctggggaaacgaatacgtggagcaaatgctgcctattctgaagcagcaccaggtcaaagcaactttctttcttgaagggaaatggctgaaaaacaatcaggaacttgggaaaaaaatagcggcagacggacatgaaatcggaaatcattcatacaatcaccctgatatgagcaaactgacttcaggaagcatttccgaacagcttgacaaaaccaatgcacaaatcagcgagacgctcggcatgaagccgaaatggtttgcgccgccaagcggcagcttcagaaaagcggtggtcgaccttgcggcggaaaaaggaatgggcaccatcatgtggaccgttgacaccattgactggcaaaaaccgtctccggctgttttacaaacaagggtgttgagcaaaatacataacggagccatgattttaatgcatccgactgatccgactgcgaaaagcctggatacactgattgcaaaaatcaaagaaaaaggctacgcgctcggctcagtgtctgacttaatggatgaaaacaggctgatgaagtagcaggcggcagtttgcctgtctttgaataggaggaacagacttgataaaacgctatacatgccaaaacggtgtaagagttgtgcttgaaaataatccaacggtgcggtctgtggcaatcggcgtctggatcgggacggggtcacgtcatgaaacgccggagacaaacggtatttcgcactttcttgagcatatgttttttaaaggaacaaataccaggtccgcacgggaaatcgcagaatccttcgatcggataggcggccaagtgaatgccttcacttcaaaagaatatacgtgctattacgccaaagttctggatgagcatgcaaactacgcacttgatgtgctggctgatatgttctttcattctgcttttgacgaagatgagctcaaaaaagaaaagaacgtcgtatatgaagaaatcaaaatgtatgaagacgcgccggatgacattgtccacgatctgctgagcaaagcgacatacggcaatcattcgctcggctacccgattctcgggacggaggaaacgctttcgtcatttaacggcgattctctcagacagcatatggatgacttttacacgccggaccgcgtcgtcatttctgtcgccggaaatgtaacagaacaattcattaaagacgtggagaaatggttcggtacatacgaagcgaagggcaaagcaagcggcatcagcgagcctgagtttcattatgaaaagctgaccagaaaaaaagacaccgaacaggcgcatctctgtctcggtttcaaaggcctgaaagtcggagatgcggacatttacgatttgatcgtcttaaacaacgtgctgggcggaagcatgagcagccgtcttttccaggatgtgcgcgaagataaaggactggcctattctgtatacagctatcacagttcctatgaagacagcggtatgctgacgatttacggaggcaccggcgcgaatcagctcggacttctgtctgaaaccattcaggaaacgttatcggttctaaaacgtgacggtatcaccccgaaagagctggaaaacagcaaagagcaaatgaaggggagcttaatgctcagcttagagagcacaaacagcaaaatgagccggaacgggaaaaacgaactcctgctcggaaagcataagaccatggatgaaattatcactgaattaaatgcggtcagcctggaaagcgtcaacggcctcagccgccgcttatttacggatgattacgcactatcgctcatcagcccgaccggcaatatgccggcttcatcttaagcagaaaagcagtctgcctctatacggggcaggcatttttttttgctccgggtcatatagtacaagggggtggctatcatgaggctcagtgaactgtcaggtaaagaaattgtggacattaaacgtgcagagcggctcggcgtgctcggccagaccgatttggaaattaatgaacaggacggacaaattaccgcgctgttgataccgacggtaaaatggttcggattgcgaaaacaaggccacgacatccgcgtcccctggaaccatatccaaaaaatcgggccagacatgatcattttagacgttccgggggagatcacgcctcccgaagagtagatcttattcaattgttgcaagcaccggctcatacagccggtgctttttttatgaaaaagacgctgtacattcaccgccctttctcttcgcacatacgatgaagaggaggatgacacttaaaagatccagtaactgtaaagaaggtgaacgtttcagatgttaaccggattgacaattgcgatcattggcggtgacgcaagacagcttgagattataagaaagctgacagaacagcatgccgatatttatcttgcagggtttgaccaattggatgacggttttacaggaaccgtcaaatgcaaaatcgatgagattccctttcaaaaaatagacagtatcatcctgcccgtatcggcaacgaccggagaaggcgttgtttccacggttttttcaaatgaagaagtggtattaaagcagagctatcttgagcggacaccggagcattgcgtcatttattcaggcatctccaacgcgtatcttgaggggatcgccagcgaagccggccgtaagcttgtgaaattatttgagcgggacgacatcgcgatattcaactcgattcccactgttgaaggaacaatcatgatggcgattcagcatacggattataccattcacggatcaaatgtcgccgttctcggcatggggcgcaccggtatgacgatcgcccggacgtttgcagcgttaggggcgaaagtaaaagtgggcgcgcggagttcggctcatttagcccgtatatcggaaatggggctttttccttttcaacttgaagagcttactgaacatgtaaatgatattgatatctgcattaacaccgtaccgagcttgattctgaatcaaagcgttttatcgcgcatgacgccgaagaccttgattttggatttagcatcccgtccgggcggaacggatttcaaatatgctgaaaaacaaggcattaaagcgctgcttgctccgggtcttccgggaattgtggctccgaaaacagccggacagattattgcgaacgtattgagcaagcttttggcagacttaaagaaagaggggaaataaccatgtctctgaaagggaaaagaatcggattcggattaaccggctcgcattgcacatatgaggaagtgtttccgcaaatagaggcgcttatcagtcaaggagctgaagtccggccggtcgtgacgtcaaccgttcaatcgaccgatacccgctttggggaggggggagattgggtcagaaaaattgaagaagcaacaggctttgaggcgattgattccatcgtaaaagcggagcctctcgggccgaaacttccgctcgactgcatggtcatcgcccctttaaccggaaattcaatgagcaaactcgcaaatgcgatgactgacagccctgtccttatggctgcgaaagccacgatccgcaacggccggccggtcgtgctcggaatttcaacaaatgacggactcggtttaaacggaacgaatttaatgaggctgatgtccgcaaaaaacatatatttcatcccgttcggccaggatgaccacgtgaaaaaaccgacatcgctcgtcgccagaatggatctccttccgattacggtagaaaaagctcttttgcaccagcaggttcagccggtgctcgtacaccatcatgaataaatcatgatgacagaaaatcattccggaataaaaaaattcggtcaatccgtgactattctatggtaaaataaaacgtaaaatgcaaagtcaattcaacaaatgatgcttaattggcggaaggagttttacagatgggaagaggattacacgtagcagttgtcggagcgacgggagccgtaggacagcaaatgctgaaaacactggaagacagaaactttgaaatcgaaacactcacactactatcctcaaagcgttctgctggtacgaaagtaacgtttaaaggcgaagaatatacagtgcaggaagctgttcctgaaagcttcgaaggcgttcatatcgcgttattcagcgccggcggaagcgtatcacaaagcttggcgcctgaggctgtaaaacggggagccatcgtgattgacaatacgagcgcattccgtatggacgaaaatacaccgctcgtggtgcctgaggtgaacgaaggtgatctgcacaaacataacggcattatcgccaaccctaactgttcaacgattcagatggtggctgcgcttgaaccgatccgcaaagcgtacggtttgaaaaaagtcattgtatctacttaccaagctgtttccggagccggcaatgaagcggcgaaagaattgtacagccagacaaaggcgattttaaacaatgaacccgcagaaccgtccattatgccggttaaaggcgacaaaaagcattatcaaatcgcatttaacgccattccgcaaattgataaattccaagacaacggctatacgtttgaggaaatgaaaatgattaatgaaacgaaaaaaattatgcatatgccgaagctggaagtggctgcgacatgtgtcagactgccgattgaaacagggcactcagaatctgtttacattgagcttgaccgtgatgacgcaaccgttgaagatattaaacagcttttgaaagaagctccgggtgttacgcttcaggatgatccggcggagcagctttacccgatgcctgctgattgcgtcggcaaacgcgatgtatttgtaggaagaatccggaaagatttggacagagcaaacggttttcatttgtgggttgtttctgataacctgttaaaaggcgccgcttggaactcagtccaaatcgcggaaagcctgcaaaaactgaacctcgtataaaacaaacgtattttctataggcgaatagaagagagtaaggctctgcctgctctcttctgttacgtcagactaatttggagtgaaaatagtgaagatcattgttcaaaaattcggcggaacatccgtaaaagatgacaaaggccgcaagcttgcgctagcacacattaaagatgccatcagtgaaggttataaagttgtcgttgtcgtatcagcgatgggaagaaaaggagacccgtacgcgacagattctttaatcgggctcctttacggcagccagtccgacatttctccgagagagcaggatatgcttctgtcttgcggagaaacgatttcgtccgttgttttttccagcatgctgaaggaaaacggcataaaagccgcagctttaacaggagcccaagccggctttttaaccaatgcccagcatactgacgccaaaattatagaaatgaaaacagagcggcttttcgctgcactcgccagccatgacgctgtcgttgtcgcaggatttcagggagcgactgaaaaaggcgacacgacgacgatcggcagaggaggaagcgatacttcagcagcggcgctcggcgcggcggtagatgctgagtttatcgacatttttacggacgtggaaggcgttatgacagccgatccgagaatcgtggaaaatgctaagccgcttccgaacgtcacatatacggaaatctgcaaccttgcctatcaaggcgcgaaagtcattcatccgcgcgcggtggaaatcgccatgcaggcaaaggtgccgatccgcgtgcgctccacttattcaaaagacaaagggactttggtgacgtcccatcattcgtctaacatcggcagcgatgtattcgaacggctgattacggggatcgcccatgtgaaagatgtgacgcaatttaaggttcccgccaaaatggggcaatacaacgttcagactgaagtctttaaagcaatggcaaatgccggaatcagcgtagatttctttaacattacgccgagtgaaatcgtatataccgtagccggcagtaaaacggaagccgcgcgcagcatcttggctgaattagggtatgagccgacagtgacggagagctgtgcgaaagtgtcagcggtcggcgccgggataatgggtgttccgggtgtcacgtcaaaaatcgtctccgcactttctgataaaggcattccgattctgcaatctgccgacagccatacgacgatctgggtgctcgttcatgaaaaagatatggtaacggccgtaaatgcgctgcatgaagtgtttgaactttcaaagtaaatgtgattgaatcatgatgaggtgaaaaaaatgaatgtcggaaatatatctacagcgatgattaccccctttgacagtaaagggaatgtagactttcaaaaactgtctacattaatcgactatttgttgaaaaacggcacggattctttagtcgtcgcaggcacgaccggcgaatctccgacactttcaacggaagaaaaaattgcactctttgaatttacagtcaaagaagtgaacggacgcgtgcctgtcattgcgggtacgggaagcaacaatacaaaagactccattaaactgacaaaaaaagctgaagaagccggcgtcgattgcgttatgcttgtcacgccgtattataataagccttcccaagagggtatgtaccgtcattttaaagccattgcggaagaaacgtctcttcctgtgatgctttacaacgtgccgggcagaacggtcgcttcgcttgcgccggaaacggccatcagacttgcggagattccgaatatctctgcgattaaagaagcgagcggcgatcttgatgccattacgaaaatcattgccgaaacaccggaagatttttacgtctattcaggtgatgacgggttaacgcttcctattctcgcagtcggcggaagaggagtcgtgtcagtggccagccatatcgtaggttctgacatgcagcagatgattaaaaactatacgaacgggcagacggcaaccgcggcactgattcatcagaagcttcagccgatcatgaaggagctctttaaagcgcctaatccggctccggtcaaaacggcgctacagctgaaaggccttgatgtcggatctgtgcgtcttcctcttatcccgctgaatgaagatgaacgtctgagcctgagcagcgtcatcagcgaactgtaagaaaaaatttatacagttaaaatacgcggtcattctcatttttatcgtgagtttgaccgttttgtatacatattggttttccctaaaccttccgcttcttcttgttttctaaaattgatatcagttataataggaacaagtgatgatggacgggtatgagactaggaggatacagattttgaaaaagaaaaatacagaaaacgtcagaattatcgcccttggcggcgtcggagaaattgggaagaacctatatgtcattgaaattgactcagacatatttgtagtggatgcagggctgatgcaccctgaaaatgaaatgctcggtattgatgtcgtcattccggatatttcctacttagtagaacgggctgaccgcgtgaaggccatctttctgacacacgggcacgatgaaaacattggaggcgtcttttatttattgaacaagctgtcggtgccggtatacggaacgaagcttactcttgcattactgagagaaaaactcaagcagtacgggcataatcgaaaagctgatttgcgtgaagttcactctaaatcagtcattacatttgaatcaacgaaagtatcgttctttaaaacaattcacagtattccggattcagtgggagtcagcttcaaaacatcacttggctctattgtatgcacgggagactttaaatttgaccagacgcctgcttatcaccaatcatgtgatattggcgaaattgccaaaatcggaaacagcggcgtgctcgccctgctttctgacagcgccaatgcggagcgcccggggtatactccgtcagaagcatatgtaagcggtgaaatttccgatgcgatgaacagttcagaaaaccgtgtcatcattgctgtattcgcgtctaatatcaaccggatccagcaagtgatacaggctgccgtccagaacggccgcaaacttgcaatcgccggaaaaaatctgcaaaacgtgcttcagcttgggcgcaaactcggctatattgaagccgaagatgaaatgtttattcctgtgcaggatgtgaaaaaatatccgaagcgggacgtggcaattgttacagccggaagccatggtgagccgctggccgctcttacgcggatggccaagcaggcgcacaagcagcttaacattgaagaaggagacaccgttgtcattgcatcaacaccgattccggggcatgaattgatatattccaaaaccgtcaacctgcttgcccgcgccggcgctcaagtcattttcgcccaaaaacgcgtgcatgtgtccggtcacggttcgcaggaagaattgaaactcatgcttaatttgctgaaaccgaaatatttaattccggttaacggtgaattcagaatgcaaaaagcgcattccaaaatcgcagaagagatcggcatgaaacgcagcgacattttcttgattgaaaaaggtgacgtcgttgaattccgcggtcagaatgtgaaaatcggggataaagtcacgtacggaaacgttctgattgacggcctcggagtcggcgacatcggcaacatcgtgctgagagaccgccgcttattatcacaagacggcattctcatcgtcgtgatctcactcgataagcagaaaaagaacctcgtatcaggtcctgagatcattacgcgcggtttcgtgtatgtcagagaatcagaaggtttaattgtacaagctactgagctcgtccgctctatcgtgactgaagcgacggaaacatctgccgtagaatggtccacgctgaaacaagcaatgcgtgatgcgctgaatcaattcctttatgaaaaaacaaaacgcaagccgatgatcattccgatcattatggaagtataatgtatacaaagccggagcgcatgatgctccggctttgtttttgttcatgtcccggatggaaatcatcatctttgttcataatacaaagagacattcggaaagggtgaaagataaaatggatcatcgtatggaaaacaccgaagaacagcagcccgaaaaatcagatgcgaaagacagcattatgagcaaaattcagcagctgggagagacatctctgccgcaaatgtcccaagataccaatattcactgcctgacgatcatcggccaaattgaggggcacgtccagctcccgccgcaaaataaaacaaccaaatatgaacacgtcattccgcaaatcgtcgcgattgagcaaaatccgaaaatcgaaggacttctgatcatcttaaacaccgtcggaggcgatgtggaagcggggcttgcgattgcggaaatgctcgcatccttatcaaaaccgaccgtttcaatcgtactcggcgggggccactccataggtgtgccgatcgccgtgtcatgtgatcatagttttatcgcggaaacagcgactatgaccattcaccccgttcggcttacaggtctggttatcggggttccgcaaacgtttgaatacttggataaaatgcaggagcgggtcgtcaactttgtgacccatcattcaaatatttccgaagaaaaattcaaagagctgatgttttcaaaaggaaacttaaccagggatatcgggacgaacgtagtcgggaaagatgcggctgattacggattaattgatgccgtgggcggcgtcggacaggcgataaaaaagctgaatcagctgattgaggaacgaaagggcgaggaaggaaggatgattcaatgatcctttataccgtcatgccccaagaagtcgtttacggacaggatatagagcaaagcgtgcatgaacaggtcgattacgccggcgtgccgctgctagttgagatgaagggaaatgaagctgaagtcgtacagattttaagtacgaacccgatggattttctgaatccggacatcgctccgggacaaaaaatcaagctgaaaatctaaccggcattcagtccgtttctcgggggcaaaatatgctataataggggaatcctacagaaaaatgcagccggcaaaaggctgcttttcttcatgaggtatgattttacattttttaacgcagtaaggtgatgagtgtggcaaagaaaaaacggaaatctaaaaagaaacaagagagtaagctcaatctaaaatacgaactaagcggactgctctgtgttgcaatctcaattattgctgttttgcagctcggcgttgtgggacagacatttgtgtacttgttccgtttttttgccggagagtggtttattttatgcttaattgcgctcttccttctcggaatttcgctgttttggaaaaagaagagtccaagccttttaacgagaagaaaggcagggttgtactgtattatcgcgagcatattgctgctgtctcacgtgcagctctttaaaaatctgtctcatcacgggtcgattcggtcggcaagtgtcatcggcaacacgtgggagctgtttatgattgacatgaaacagcaggctgcttcccctgatttgggcggcggcatgatcggcgcggtactgtttgcagcttcccactttctatttgcatcaacgggttcacaaatcatggcgatcgtgctgatcttaatggggctgattcttgtaacgggccgttcactgcaggaaacgctcaaaaagtggacgagccccgtcggccggtttatccgcggtcaatggcaggcatttcttgaggatatgaagacggtcagaacgaatatgtcttcgccgaaaacaaaaacaaaatcgggcaaaaaacaaaaacgggttcaaaagaaaaaagaagagcctgaaccggaggaagaggatgatgaaatcatttcgccgatcatccattcagagccgattatttcaagcttttcagaccgtcaggaagagcccgccgaagaaccgctgattccggaaaaaacgcaggaggctgcacaagcggcaaaagttgagccttccggcggcgctcaagacagtggcgaaacggctgcggctccgccgatgacgtttacagagcttgaaaataaagattatcaaatgccttcattggacatactggctgacccgaaacatacaggccagcagaccgataagaaaaacatttacgagaatgcaagaaaactcgagcggacttttcaaagcttcggcgtaaaggcgaaagtgacgcaggttcatctcggtccggcggtcacaaaatatgaggtgtatccggacgtcggggtcaaagtcagtaaaatcgtgaatctgagcgatgacctcgcgctcgcgcttgccgcgaaggatatccggatcgaagcgccgattccgggcaaatcggcaatcggcatcgaggtgcccaatgctgaagttgcgatggtttcgttaaaagaagtgcttgaatccaagctcaatgacaagccggacgcgaagcttctgatcggcttggggcgaaatatttccggggaagccgtgcttgccgaactgaacaaaatgccccacctgctcgtagcgggggcaacgggaagcggaaaaagcgtctgtgtcaacggtattattacgagcattctgatgagggctaaaccgcatgaagtgaagatgatgatgattgacccgaaaatggttgaactgaatgtgtataacggcattcctcatctgcttgcgccggtcgtgacagatccgaaaaaggcctcgcaggctttgaaaaaggtcgtcaatgagatggagcgccgctatgagctgttctcccatacgggtacgagaaatatagaaggctataacgaccatattaagcggtcaaatgccgaagaagaagtcaagcagcctgagctgccatacatcgtcgtcatcgttgacgagcttgccgatctgatgatggtcgcttcttccgacgtggaagattcaattacgagactttcacagatggcgcgagcggcgggaattcatttgattatcgcgacacagaggccttcagtcgacgttattaccggtgttattaaagccaacatcccgtcaagaatcgctttcagtgtctcatctcagaccgattcacggacgattttagacatgggcggcgctgaaaagcttctggggcgcggagacatgctgtttctgcctgtgggcgcaaataagccggtgcgtgtgcaaggggcattcttatccgatgaagaggttgagcatgtcgtcgatcatgtcattacgcagcaaaaagcgcagtatcaagaagagatgattccggaagaagtttcggaaacacacagtgaagtaacggatgacctctatgacgaagcggtcgatttgattatcggcatgcagacggcatcagtctccatgcttcaaaggcggttcagaatcggatatacgagagctgcccgtctgattgacgcaatggaggaacggggcgtcgtcgggccgtatgaaggaagcaaaccgagggaagtactattatctaaggaacaatatgatgagctctcttcttaaaaaggagagagttttcactgaaaatgatatcaccaaaatcattcctatttatttttttatcaaaacatgatatagttgtcccaattgttcaataatttatgaaagtggtttacggaggggaaacatgtctacaaaagctgacaatcgtcacttgtatctaaaagtgattgagcgaatcaaagaggatatacaaaacggaatttacaccgaaaaggaaaagcttccttctgaatttgagctttcaaaatcaatgggtgtcagccgggcaactctgcgtgaagctttgcgtatccttgaagaggagcatgtgattatcagaaggcacggtgtgggcactttcgtccatacaaaaccgctgtttctttcaggtattgaacagctcaacagcgtgacgaaaacgattcagcaggcgaacatggtgccgggtacgatttttttgtcgtctcaggtcatcacgccgtctgatgaagatatcgctagattccggcttgagcctgagcaggagcttttttatttggaacgcgtgagaacggcaagcggcactccggtcgtttactgtttagatacgattccgatgcacattctgccgaattctttctgtcatgaacaggagtctatttttgatcttttggaaaaaaactccgggtctgtgatcagctatgccgttgctgatatcgaaccgatcggatatcacgatacgatttcaccggttttggaatgcgagccggagacggcgcttttattgctgaagcaaacccactataatcagaatgatgaacctgtgctgtattcattaaattatttccgggctgataagttcagttttcatgttgtaagaaaacgtttttaagacagacgcgtcatgtgtctgtttttttatttgccgtttcagtacatactttgttttctgcaaggcacaataaaacaggaaacaaccaagtatagtgaatgggtgaataagttgagtaagaagaaaaatggaacgaaaaatatcattgctctggcttctgtaccgctcgtgatgacactcgggaattccatgctgattcctgtgcttccgatgattgaaaagaagctgtccatatcgtcttttcaagtatcgttaattataacggtctattcgattgtggcgattatttgtattccgattgccggatatctgtccgataaattcggaagaaaaaaggttcttctgccttgtcttctcatagccggcgcgggcggagcgcttgccgcgatagcttccaccgcgttcaagcatccttatcccattatcttggcggggcgggtgctgcagggaatcggttcggcaggggcggctcctgtagtgatgccgtttatcggtgatttattcaaaggggatgatgagcggattaccgcggggctcggcgatattgagacgtctaacacagccgggaaagtaataagcccgattctcggttcgctcttggctgcatggttttggtttatgccgttttggttcattccgtttttttcgctcatcagtttttttctcgtattgtttttggtggcaaagccggaggaacaaaaagaagcgccttctatttccgaatttgtgaaaaatgtcggccgcatatttaaacgtgacggacgctggctctttacggtatttatcatcggctgcgtgattatgtttttgctgttcggggttcttttttatttatcagactcactggagaagaaatacggcattgacggtgtggctaaaggagcgcttttggcaatcccgcttttatttctatccgtcagttcatatatatcaggcaggaaaatcggaaaagaccaaggcaaaatgaagttttgcatcgttttcggaatgagtgccgtgacactgtcgtttatcggcctatggtggaatcacagtttttatttattatttatctttttgtgtgtcagcggtatcggtatcggaatggcattgccggctttagacgctgtcatcacagaaggcgtagacaacgaggaatcgggaaccatcacctcattttataacagcatgcggtttatcggagtagcggcgggaccgccgatctttgctgccctgatgtcaaatgcaggctggctgatttttattttatccgctttttgcggcattgtgtctgtatttttagcgctgttaaatatctcatcacaagcaaaagaaaagaaggaatcattaaagacggtgtaatctgcactgtctttttttattttattttgaagattgacatgataccgtcaagtcgttattctttttaatagttaaacatattaactatcggaaggagggggaaaaggtgcatgaagaaaaagtaaagcagctgattcagcgttattccgatgtatacctgcacgtcttaaaaaaaattgacagtattatcgctgaaaaagtgaacaaagaactgacattggatcaatattatatcctccgctatattatgctcaatcccgattgcaaatcaattgaactggccgcggtgtgccacgtcaataaaagcgccattacatctatgacgaaccgcctgtatgaaaaaggctacatcaatagagaacgcagccaaagcgaccgccggagcatacttttaaatgtcacggaaaaggggacggaagtatttcaccgtgtggagcggcggattgaggaactcgtccgttcatatattatgtattttgatgaagacgaggcggagatgttcgtgaatacatatgaaaaattatatcgattgatgatgacagaggaggatcagcagacataatgaaaaacattatccgagcccgctggatcatcgccgcggtatgggtcgccgcaacggtgatatttatgcttacagcgcctgatatggctgaattgacacgggagaaagggcagatttccgtaccggacggatattcctcttcttacgcccatgaattgcttgatgaaatgtctggttcagatgcaccgtcttcttctgccgtcatcgtatttcacgaaaaaggcttaatgacagacaaaaaagatcgtctggaagaagccgtcagcactttgtctgaacataaaaaagcgcttcagattaaaacgatgacctcatacttcggggagaaaaatgacgacatcaaaaaacagctgctgtcaaaagacagacaaacgatgctcgttcagctgcagcttgatacatccaaaaacgatatcatcgaaataaaaaataaaattgataaagagctgaaaccgtacggcgtatcatacggcattacaggccaatcgctgatcgacgaagatgtgttaaaaagctcacaggacggcttgaaaaagactgaatatataacggttgcctttatcctgatcgtgctgattcttgtatttcggtcagtggtcgctccgtttgtgccgcttttatctgtattgatatcttatttagtcagccagtcgattgtcgcatttttagtcgatcagctggattttccgctctcaacttttactcagatttttatggtggcgattatgttcggaatcggcacagactattgcattctgcttctcagcaggtttaaagaagaactgtcgcatggcgctgatataagagaagcgatcgtcgtgacttacaaaacggccggaaagacggttttgtacagcggcggtgcggtgctgatcggatttgcctgcatcggatttgcgacatttaagctgtatcagtcggcagcggccgttgcggtcggtgtcgcggtgctgctgcttgcgctcatgacgatcgtgccgttttttatggctgttttaggaaaaagactgttttggcctgttaagggcgatatttcccatcctcaaagcaaagcatgggaaacgtcagggcggttttcatttaaaaggccgctcatcagtcttgcaatcgttgcggtattcaccgtcccgcctatccttctttacaaagggtcgctatcttacaacagtcttgacgaaatcggggataaatatgaatccgtccgcgcgtttaatacgatttcagacgcattcggcccgggagaacttcttccggccactgtcgtcatcaaaaatgatgagactctaaataccgaaaaacacctgattgatatcgaaaaaatcagcagagaacttgaaaaaacagagggtgtaaaaacggtcagaagcgccacgcgccctgctggaaacggattgaatcaattatttgtcacaaatcaggcaaagcagcttcaagaagggcttgataaaggcaatacaggacttgaaaaaatcacggacggattagggcatgccgcaaagtcgttagttgattcacagccgcagatcgaagagtcggggaaaagcgtcaatcagcttattgacggaacattgtctctgaaatccgggctttctgatataggagaaaacctgaataaactgcaggctggcgtgaacgagaataaagccggcgtcgcccagatgagaaagcagattgaagagcaaaaacaaatgctgacttcacagctcagccaaaatagcggtctcgcttcagaaacgcaaaacgctttaaaattggtaaaaaccgtcctgccgatgaaagatgaagccagcagacagcttgccgatttgaacaagcagcttgcccggctgccgtttgcaaaattggaagcgtcaataccgtcagtcaaaaccgatccctcttaccaagaaatcaaatcggcctttacgggtgtacagtcagccgtttccaaggcaaacgcggatgcagaagctttttctaaacaggtcgacagtcaaaaggatcatctgcagcaagcggaaaaacaatttgcccggctggcagccgctcagaagaagattgacactcaaattaacgcaatgatcaacggtttgaccagtattgaaaacggtctgcagcaagtgtcagacggacagggggctctcgcaggacaaatgccgcgccttgaatcggcggcaggacagctcgcggagggccagaaaaaaatgaagagcggtctcggtgatttttcttcccggctcagcgatctttcttcaggccttaacgacagtgtaaaagggcttaagaaagtatcaagcggcatgatgggggcgaatgattacctgggtgagcttcacaaggcgtcagacaaagaaatgacaggctggtttgtgccgaaagacgccttgaaaaacagtgatttcacaagcgtgtttaatacgtacatgtcagatgacagaaaaacgacagaattgactgtcgttcttgataacaatccttactcaaatacggccattcaagatattcaagcgatcaaagcgagcgtaaaaagggccattccgaacacggatctgaagaatgcttccttcggcgtttcgggagtctccagcatgaatgccgatctgaaggaagtatcggattcagacttcaaacggacggcaatgtttatgctggcgggaatttttctgattctcatcgtgatgctgcgctccctcattatgcctgtttatttagtggcgtcgctcgtactgacgtatttcgcatccatcggcgtaacggaatacatctttacacacttcttcgggtatccgggcgtaaactgggccgtgccgttcttcggctttgtcattttgatggctcttggcgtggattattccatctttttaatggaccgctttaatgagctgaaaaaagaaggaacggaacccgcaatgatcagcagtatgaaaaatatgggttccgtcatcatttctgcggcgattattttagcgggaacctttgcggccatgctgccgtcaggcgttctttccttattacagattgcaaccgtggtattaacaggccttctcatgtacgcaattgtcgtccttccgttttttgtaccggtcatggtgaaaatattcggaagagccaactggtggcctttcaatttgaaaaaataacgttcaatgcctctgcctgttttcgggcagagtttttttgtttccttataaatcctccagttgatataattacatctgcgtactcttttttgcgaatgctgaaatttggtcataatacatactatgaaagaatgaacgaaggaggtttcacatgacttacgtaaatgaaatgaagtcaaagcacggcgggatcaccgcccacatcgtaaagaccgagaaatttaaaaccgtttcgctgacgtttaaaatgctggctcctttaacgaaagagctcgtaacaaaaagggcgctgtttacgcatgtgcttctgcgcggaacagaaagccgcccgaaaaccgctgatctgcggtcttattttgatgagctgtacggcacatccgtttcagctgatctgacaaaaaagggagaacgtcatgtcattacgttcagacttgagattcctaatgaaaagtatctgaaggaccgcacaccgttattggaaaaaggtcttcagcttttatcagagcttgtcttttcgcccgctttggaaaacggcgccttcctgcccctttatgtcacgcaggaaaaacggacgctgaaacagcggattcaagccgtatatgatgataagatgagatattctaatctgcgtctcgttcaggaaatgtgcaaaagcgaaccgtatgcgcttcacgtcaacggcgagttcgatgatgttgaacacattacaccgcaagatttgtatgaagcctatcaaaaagccatacgcgaagaccagctggacctgtacgtcatcggcgatgttgatacagatcaagtgaaaacggccgttgatacgtattttaaaacggaagaacgggagctgcagccttttgaaagaagcgcggcgaatgaacagcccgatccgaaggaagtcattgatgaagaggacgtcaagcagggcaagctgaatatcggattccggaccaatacgacatatacagatccggattatcctgcattgcaggtgtttaacgggctgttcggaggtttctctcattcaaagctgtttataaatgtccgtgaaaaagcgagcctcgcctattatgcagcctcaagggtggaaagcttcaaagggcttttgatggtcatgtcgggcattgaggtgaaaaattacaagcaggccgtcaccatcattgaagaacagtttcaggctatgcaaaacggtgacttttcagaagatgatatcgcccaaacgaaagccgttattaaaaatcaagtattagaaaccattgatacggcatacggtttagcggaatttctgtatcagcaggcctcagcccaagtagagataccgatcgaaagattccttgacaatatcgagaaagtgacaaaagaggacattatcaatgtcggaaagaacattaagctggatacgacttatttcttaaaagggacggggggagcatcttgactaaaccgataaacttcgaacagcttcaagaaacgctgtatcatgaaaaaatggcaaacggccttgatgtctatgtgctgccgaaacagggctttaataaaacatacgccgtgtttacgacaaagtacggttccattgacaatcaattcgttcctttaaataaggaagaaatggtacacgtccctgacggaatcgcgcattttctggagcataaactgtttgaaaaagcggacggcgacgtgtttcaggacttcagtaagcagggggcgtcggcaaatgcctttacatcatttacacgaaccgcttatctgttctccagcacttctaatgtggagaaaaacctggaaacactcgtggattttgttcaggacccgtatttcacggaaaaatcagttgaaaaagaaaaaggcatcatcggccaggaaattaatatgtatgatgataatccggattggcggctgtttttcggccttatcgaaaatatgtataaagaccaccccgtgaaaattgacattgccggaacggtggagagcatctctcatattacgaaagatctgctgtatgagtgctacgaaacgttttatcacccgagcaatatgctgctctttatcgtcggtcccgcagatcctgaagcggtcatcagccaggtgcggaaaaaccaggagaaaaagccgtttacagaccagcccgaaatcaaacgtgaagaagttcaggagcaggaagcggttttccgccgggagcaggagttgaaaatgaacgtgcaaggctcaaaatgtcttgtcggcttaaaggcgaaagacccttataaaacggggcgggagctgttgaagcacgagctcagcatgaacctcatgcttgaatgtctcttcggaaaaagctcaccgcattacggtgacttgtacgacaaaggctacattgatgaaaccttcagctttgattacacggctgaatacggattcggttttgcctctgtcggaggagatacaccggagccggataagctcgctgacgaattaaaacacatgctgcttgatgcggaatcagccgtgactgcggaaaaacttgatcttgcgagaaaaaagaagatcgggtcattcttaaaagcgctcaattcgcctgaatatatcgccaaccaatttacacgctacgcctttttagatatgagtctgtttgatgtcgtaaccgtactggagcagattacgctggaagacgtaaagcgggtcattaaagaagaaatatcagaagacaggctgacagtctgcaaagtcgtgccaaaatcataacaaaaacatccctcacgccctgagggatgtttttctggggaaagaaggagtattgattgatgaaacagacagcgctcgtaaccggagcaagcggcggaatcggacaaagtataagtgaagtcctcgcaaaaaacggatatgacgtccttttgcattatcattctaataaggaagccgcacacaggcttgcggaaaggctgagcgcatcattcggcgtaaaagcctccgttattcaggcggatctgtcctcaccggatggcgcggagacactcagccgttccgttaagcagcctgtggacgccctgatactaaacagcggcaaaagtcatttcggcctgattacggacgttacggatgacatggcgcgggagatggtgcagctgcatgtgacgagtccgtttcttttggcgcgtaatctggtgcccggcatgatccgggaaaaaagcgggggcatcgtcgcgatcggttccgtctggggagaaacaggcgcatcgtgcgaggtattatacagcatggtcaagggagcgcagcattcgttcgtcaaagcgcttgccaaagagcttgctccgagcggcgtccgcgtgaatgcagtctcgccgggtgccgttgatacaaatatgcttgatcagttcacgtctgatgaaaaagaagcgttggcagaggaaattcccgcgggccggctggcaaagccggaggaaatcgccgaagcggcggcctttttattatcggacaaggcttcctatattacggggcatatattatccgtaaacggcggctggcactgctgaaaaaaatgtgtgtatagtttgcatctgcacggacaaaataattttgtaacaacagatgaaatggaggaacccaacatgtcagtattagaaaactgggataattggaagaatttccttggcgacagattgaactatgcgcaggaaaaagggatgagtgatgaaacgatcactgacctcgctacagaaatcggcggttaccttgcgaacgaagtcgactcgaaaaaccatcaggaaaaagtgcttgctgatctttggagcgttgcttctgaagatgaacagcgcgccatcgcaaatatgatggtgaagcttgttgaaaataacagcactcattaagaggggggatttctcctctctttttttatgttttcctctatagagcaacattcttctttctaattagagaaaaatgttttatgataaaggaaggtaaaaatttgccacaatggagggggtatatcatttggcaaagctcgaatggtattttgaatatgaaattcaagtgaaccgccccggcctgctcggggatatttcatctcttctcgggatgctgtcaattaatattgtcacaattaacggtgtcgacctttccagaaggggaatgctgctcagatgccggcatatagatcaaattaaacgattggaatcaattttaaaaacaatggagaccattaaagtaacgaagctgagagaaccgaggcttcgcgaccgtctcgcagtccgccacggaagatacattcagcgtgatgccgatgacaaaaaaaccttccgttttgaaagggacgagctcggtcttctggttgactttatggccgagctgtttaaaaaagaagggcacaaactgatcggaatccggggaatgccgagggtcggaaaaacggagtccatcgttgcgtcaagcgtttgtgccagcaaaagatggcttttcgtatcatcaacgctgctaaaacaaacgatccggagccagctggttgccgatgaatacagcacggaaaacgtgtttatcctcgacggcatcgtttcgacaagacggggatctgagcgccatcttcagctcgtcagtgaaattatgcggcttccggcgacaaaggtcgtggagcaccccgatatttttgttcaaaattcggagtatacgctcgatgatttcgattatattatcgaactcagaaatgatcctgacgaagtcattacatatgaacatgcagaagaaccgcaaatgtttgatcagaccggtttttcaagctttgatttttaatattggaaggtgtttgttgtgacagaattagcaatccggcttaaagaagccagagaggaaaaagggatgtcattggatgaactccaggcggcgacgaaaattcagaaaagatacttaaccgctctggaagaaggcaattatgacgtcattcccggcaatttttatgtgcgggcgtttatcaagcaatacgctgaagctgtcgggcttgattccgatcagttatttgaagaatataaaaaagacatccctaacacgtaccatgacgatgtttcggaaaaaatttccggtctcgccatgcaaagggagcttcctaagtccgcttcaaaggcggcggaatggcttccgaccgtccttgtcgtcatcggtgtcattatcgtcatcgcgatcatttatgcgattattcagctcggaatgagcaaatccggacagacagacggagataaagccgtcacccaaagtgagagcaagtatgagattcctaaggattctgcgctgaaaaacgacggcaatacaaatgacgaagcgcaatctgacagcaagaaagataaaaaggacacaaaagcatcagagcagaaaaagaaagaaaaaagcagtgaaacgacggagatcaaagcggccggaacggaaggctcagcttcttcatacaacgtctccggggcagataagtataagcttgaactgattgcttctgacagcgcatggatccgcgtccgtgatgacagcggcggttctttaaaagaaggaacgctgcaaaaaggcgaaacctttaaaaaagacgtcacggatcaaaagcagattgaaatccgcacgggctatgcccctaacctgaaaattaaaatcaacggagaggttctgtcctatgaactcaatccgcatgatgtgatggcgcagaccatcacaatcaagatgaaaaaataaaaggggaaaagtcatctgaacgattaagatgactttttcttcacgtccgagtacatattattggaggggctttatgtttaacttaccgaataaaatcacactggcaagaatcgctttaattcctgtatttatgattatcatgcttgttccttttcagtggggcagcgttcatataggggatgaatcgattccggtagcgcatcttacgggagctgttttattcattatcgcatcaacgactgactgggtggatggctactacgccagaaaactgaacctcgtgacaaacttcgggaaatttttagatccgctggctgacaaactgctggtatccgcggcattaattacgcttgtgcagtttgaccttgcgccggcgtggatggtcatcatcatcatcagccgcgaatttgccgtaacgggattaagacttgtgctggcgggaacgggggaagttgtagccgccaatatgctggggaaaattaaaacatgggctcagatcatcgctgttgccgcgcttttgctgcataatcttccgtttgagctcgtttctttcccgttcggcgatatcgctttatgggtagctgtgctcttcacagtcatttccggctgggattattttgcgaagaactgggatgcgttaaaaacatctaactaagaaagaaggacttaaagatggaaatagcaaaaaaagcagagatcattgcagtcggctcggagcttctgctcggccagatcgccaatacgaacgcgcagtttatcagtaaagagctggcggaaatcggtgtaaacgtgttttatcataccgctgtcggtgacaatccggagcggcttaagcatgtcatccgcattgccgaagagcgctcagacctgattattttttcaggcggcctcgggccgaccaaggacgatttaacgaaagaaaccattgcaaacacactggggcgcccgctcgttctgaatgacgaagcattccggtcgatcgaagaatatttcgtgaaaacaaaacggaccatgtcgccgaataaccgcaaacaggcgctcgtcattgagggctcagacgttttggcgaatcatttcggcatggcgccgggaatgcttgcagagcacggctcaaggctttatatgctgcttcccgggccgccgagcgagctgcgtccgatgtttgaaaatgaagcgaagccgctgcttcttaaaaagctcggttctaatgagaaaatcgtttcaaccgtgctgcggtttttcggaatcggtgaatcccagcttgaagctgatttagaagatatcattgacgcgcagacgaacccgacgattgcgccgctcgctgctgacggtgaggtcacgctgcgtttaacggcgaaacatgccgacgaaaaagaaacagaacggcttttaaaagaaacggaagccgccattttagaacgtgtcggtgaatttttctacggatatgatgatacgtctctggtgaaggagctttcaaaagcatgcagacaaaacaaaatcacgatttcttctgccgaaagctttacaggcggcctgttttcagagtgggtgactgatttaagaggtgcgtctcaactatttgcagggggcgttgtctgttattccgacagcgtgaaacagcatgtgctcggcgtgaaagctgagacgctcgcagaaagcggagcggtcagcaaagagtgtgcgaaagagcttgcagccggtgtgagaaagctgaccggaagcgatatcggcatcagctttaccggggttgcgggtcccgacccgcaggaagggcatgctccgggccgcgtctttatcggcatttcagcggaaggaaaagaagaggtgcacgaatttaactttgccggctcaagaaccggaatcagaaagcgcgccgctaaatacggctgccatctcattttaaaaatgctggatcaaaaataaagttttaaagaggcattttctctgatttttaagtttcacaagggaaattatgctcttttgcagaaaagcgaacgcggaaaaaatccgaatatgcgttcgcttttttcttggcaaatgccagtaaacaaggtatagtatatgtagtggcaagataaaggaggaaaaaataaatgagtgatcgtcaggcagccttagatatggctcttaagcaaatagaaaaacaattcggcaaaggttccatcatgaagctcggagaaaaaacagatacaagaatttcaacggtgccaagcggttcccttgcacttgataccgctctcggaataggcggatacccgcgcggacggattattgaagtatacggacctgaaagctcaggtaaaacgactgtagcgcttcacgcaatcgctgaggttcaggaaaaaggcggacaggcagcatttattgatgctgagcatgctcttgatcctgtttacgcgcaaaagctcggtgtcaatatcgaagagcttctgctttctcagccggatacgggagagcaggcgctagagattgctgaagcgctggtgcgaagcggagctgttgatatcgtagtcgttgactctgttgcggcgcttgttccaaaagctgaaattgaaggtgacatgggtgattcacacgtcggtttacaggcgcgtctcatgtctcaggcgctccgtaagctttccggcgccatcaataaatctaaaacaatcgcaatctttattaaccagattcgtgaaaaagtcggcgttatgttcggaaatccggagacgacaccggggggccgcgcgctgaaattctattcttccgtgcgccttgaagtgcgccgtgccgagcaattaaagcagggcaacgacgtcatggggaataaaacgagaattaaagtcgtaaaaaacaaagtcgctcctccgttccgtacggctgaagtggacattatgtacggtgaaggaatctccaaagaaggggaaatcatcgaccttggaactgaactggatatcgtccaaaaaagcggttcatggtattcttatgaagaagaacgcctcggccagggccgtgaaaacgccaagcagttcttaaaagaaaataaagacatcatgctgatgattcaggagcaaatccgtgaatattacggtttggacaataacggtgtaacggacaaagcggaagaagttcaggaagagatggaattagaagaataaaaacacgatcaaaagagcggaataagcaatttccgctctttttttgtgtgtttcaaaaaacactggctgtttcggaaaattttatctggaatgttacaacttttttcacccttcactcgtctaacatcatggcgaaagttgaaattatatctgaggaggaaaaaagatgacgagcccccgccgcacaagaataaataaaaaaagaaagaagaagctgatgaaaacgggagggctgtttctttttctgctgcttgtcactgtttttattatgatctggaccgtcacagcgcatcaccgggagaaggaatccgttaaaagcgctcccgccgctcaatctgatacttcaaaagaccagactcaacagaaaaaagaaaagacgcaaaaagagaaaacacctaaatcaatcgatcacaataaacagatcagcaattacttgcaacagatcgggttcagcggcacagcaatgatcgtaaaagatggaaaagttgtgctgaaaaaaggctttggctatgcggaccgaaaacaaaaaattaaaaacaatccggagacatcatattatatcggttcttcacaaaaagcgttaatcgcgacggctgtcctgcagcttgaagaaaaagggctgctgcagacgagtgaccccgtcagtacatacttgccgaattttcctaacggcacgcgcattacattgaaaaacctgctcaatcatacgtccggcataaacgggcatattgagggtcagggaccgatttctccaattgatttaatcaaggatatagaaaaccgcggaattaaacggcagcccggggtttgggattacagggattccaactattcagtgcttgcttatatcgtatctcaggtcagcggggagtcttatgaacaatatataaaagaacacgtgttcaaactggccggaatgaagcatgccggattttacaaaacatttgccaaagccaaatatcctgccgtcggctacaaagtcgatgagagcggcagtcttataacgccgcaccttttggacttatcgcagctgtacggggcgggcgacatgtatatgagcgctgaagatctctataaatttgataaagcgatcgtaaacaacacgctcctttcaaaagcaagcttcacaaaaatgtttacagcaggaagcagtgccgcttacggcatggggttttacattgatccgggaagctattccaatcacggtgttatgcccggttacaacattttgaacagcttcagccattcggcaagcaaatatgtcatattactgtcaaacattcagaataacgccaaattgggacaggtaaacaatagaatttaccaattgcttaaccaggcggactgacagagccgtcattcacgaaaagcggatctaggtatggtatgatatatacatggcgaagattccgagctgaaggcgaatcgttaagctggcaagcttgacaagtatttccgacacaattacaatgaagttgtaacatttgtttttttaacatgattgttaaaccatttaaacttgacaagggcatgagagactcattccctgtgaaggttctgtatgttgagaaaatcaaacaatgtacatgccggcacttatttaagcaaaaaccaagttcatagcaagaggaggtgaaagtatgaccccaatgacggttctcatctccattttgctgactctgctcggtttagttgttggctactatgttcgtaaaaccattgccgaagcaaagattgcgggcgcacgcggtgctgccgagcaaatccttgaagatgcaaagcgtgatgctgaagcactgaaaaaagaagctctgcttgaagcaaaggacgaaatccatacacttcgaatagatgctgaacaggaagttcgtgaaagacgaaatgagcttcaaaaacaagaaaaccgtttacttcaaaaagaagaaaatcttgaccgtaaacatgaaggaattgataaacgggaagcgatgttggagaagaaagatcattctctgaatgaacgacaacaacatattgaagagatggaaagcaaagtggatgagatgattcgtatgcagcagtcagaactcgaacgcatttcgagcctgacacgggatgaagcgaaacaaatcattcttgaccgggttgaaaatgagctttcacatgacatcgccatcatgacaaaagaaaccgaaaaccgtgcgaaagaagaggcagataaaaaggcgaaaaacattctgtcgcttgctttgcagcgctgtgcagcagatcatgttgccgaaacgacggtatcggtcgtcaatcttccgaatgatgagatgaaaggacgtatcatcggccgtgaagggcgtaacattcgtacgcttgaaacgcttacaggtattgacctgattattgatgacacacctgaagcagtcattctttccggatttgatccgatcagacgggagacggcaagaatcgctcttgataaactcgttcaggatggccgtattcacccggcgcgcattgaagaaatggttgaaaaatcccgccgtgaggttgatgactatatccgggaaatgggtgagcagacgacgtttgaagttggcgttcacggactccacccggatctgatcaagatcctcggccggttgaaattccgtacaagctacgggcagaacgtactgaaacattctatggaagttgcgtttttagccggtttaatggcttccgagcttggagaagatgcaaagcttgccaagcgggccggtcttctgcatgacatcggaaaagcaattgaccatgaagtggaaggaagccacgtggaaatcggagtggagcttgcgaccaaatataaagagcatccagtcgtcattaacagtattgcgtcacaccacggagacgaagagccgacttccattatcgccgttctggtcgctgccgctgatgcactgtcagccgcaagaccgggcgcgagaagtgaaacgctcgaaaactatatccgcagacttgaaaagcttgaagaaatctccgagtcttacgaaggtgttgaaaaatcatttgcgattcaggccggccgtgaagttcgcatcatggtgaagccggactccattaatgatttagaagcccatcgtttggcacgtgatatccgtaaacgaattgaggacgagcttgattatccgggccacattaaagtgaccgtaatcagagaaactcgagccgtagagtatgcaaaataaagtgatgcttagcgcatcactttatttttttgagtccctgaaaaggaaggaatggaatgtatgagaattttatttatcggagatgttgtcggttccccgggccgcgacatggtaaaagaatatgtcccgaaactgaaagcgaaacataaaccgcattttacaattattaacggagaaaatgcagcacacggaaaaggactgacagaaaagatctaccacagcctgatggaagcgggagccgatgccattacaatgggaaaccatacgtgggataaaagagagatcttcgactttattgatgatgtgccgcatcttgtccgcccggcgaacttcccggaaggtacaccgggcaaaggcattacctatattaaatcgaacggaaaagagcttgccgtcattaatttacaggggcggacgtttcttccgccgcttgatgatccgtttgctaaagcggatgaattaatagaagaagcgaaaaagcgcacgccgtacatttttattgattttcacgccgaagcgacaagcgaaaaaattgcgatcggctggtacacagacggaagagcctctgccgtggtaggcacccatacacacgtgcaaacggcagataaccgcattttaccgaaaggaacggcatatattactgatgtaggcatgacgggtccgtacgacggaattctcggtatggacagagaaacggtcatcaagcggtttaaaaccaatcttcccgtccggtttacggtggcggaaggtaaaactacgctgagcggagtgctcattgacatcgacgatcaaacgaaaaaggccgtaaatatcgaacggatattaatcaatgatgaccatatgttctttgaataggtgatcatgtgtttattttataaaaatattaaaaggaaaagcaggaatatagcaacttcttagtgaatatagtagaaatggaaggtagcccgctatttttgaaaagcattgtggggatggctttttggatagcaacatctaataatgattgttctaatgaacactcacttatccattgtaaaactaagggggagcagaaatggaaatcttaaaagtttcagcaaaatcaagtccaaattcagtagcaggcgcgcttgccggtgtattgagggaacgcggagccgccgaaattcaagcaattggggcgggtgccttaaaccaggctgttaaagcggttgcgattgccagaggctttgtcgcgccaagcggcgtagatttgatttgtattccggcttttacagatatacagattgacggagaagaaagaacggcgattaagttaatcgtcgaaccccgttaaaaacaaaaacatgatattctcaacctgcttgcgtaaggcgagcgggttgtttttattgttgtcatattttctcacaatattatattgatagtacgaagagatgataaatggctttattcatataatattcaaaaaaaatcccgcccatttttccggacggaagcagttgttttcttggagtggacactggtatttacctcctttttatatcatgttacaatccagttattacagtgttttttcgaggaggagtgtacgtgttgggaggaaagatgaaagctatcgtcaaaaatgaaaacgctttcggagcaactctgaaagaaattcccataccttccattaatgagaatgaagttctcattaaagtacaggccgcatctatatgcggtacagatgtgcatatttataattgggatcaatgggcgcagaaacgaatcaaaacacctcaagtattcggacatgaattcagcggtatcgtagcggaaacgggcaagcacgtcacaaatgtcaaaataggtgactacgtttcggctgaaacccacttcgtctgcggtacttgtgtcccttgtttaacaggaaaacatcatgtgtgcacccatacaaagatcctcggcgtagatacagccggttccttcgctgaatatgtcaaagtgccggctcgaaatgtttgggaaaatcccgctgatatggaccccgccgtcgcttctgttcaagagccgcttggcaacgcggtgcatacggtgctggaaaacagccagcttgcgggcggttccgctgcaattatcggttgcggaccgatcggactgatggcggtggcggtggctaaagcggccggtgcgtcccgtattgcggccattgataaaaatgattacaggctggctcttgcgaagaaattgggagccacgatcaccattccagctgacgaggaagatccgcttgaggtgatcgacaccttaacaggcggagaaggaatcgaccttgtctgtgaaatgtccggccacccgacagccataacacaaggattaaagatggcggccaacgggggaaggttccacatgctgagtctgccggaacgtccggtgacggttgacctgacaaatgacgtggtgtttaaaggacttaccgtccaaggcatcacaggcagaaaaatgtttgaaacatggcggcaggtatcgcacctgcttgaatccggccttgttgatctgacgccggtgatcacgcatcagtttccgcttgaagactttgaaaaagggtttgacctgatgagaaagggccagtgcggcaaagtcattttgattccataaggggagggttctataatgaaagaatttgaatttctaaaagccgagcttgataaaatgaaagaaaataaaacgtggcagcaaatgaaacaaattgaaacgaagcagggtccgtcggtggaagtcaaaggggaaaacgtgatacagctttcatcgaacaattatctcggtttgacgtcgcatccaaggcttgtcgaagcggccaaacgcgccgcggaagaattcggagcgggtacggggtccgtccggacaatcgccggaacattcacaatgcacaatgagctggagaagaaattggcaaactttaaaaaaacagaagcggcacttgtttttcaatcggggttcacaacgaatcagggcgtcctatcaagcattcttacaaaagaggatatcgtgatctctgacgaactgaaccatgcttccatcattgacgggatcaggctcacaaaagcagataaaaaggtgtaccgccatgttgatatggacgatttggaaagggtgctgaaaaaatcgatgaattaccgcatgcgcctgatcgtcaccgacggcgtattctcaatggacggcaacatcgctcctttgcctgacatcgtcaaacttgcagagtcgtacgatgcctttgtgatggtcgacgacgcgcatgcttccggcgtactcggaaaaaacggaaggggaacggttaatcacttcgggcttgacggaagagttcacatacaggtgggcacattaagcaaagccatcggagtgcttggcggttacgccgcggggtcgcaggttctgatcgattacctgcgccataaagggcgtcctttcttattcagcacttctcatccgcctgcggtaacggccgcatgcatagaagccattgacgtcctgctggaagagcctgagcatatggaaaagctgtgggagaacacggcgtatttcaaagataaactggttcaaatggggctgaccctcacaaaaagcgaaacaccgatcgtgccgatattaataggggaggaagaaaaagcccaggcattatcagaccttttattgacccgcggcgtctttgcacaaagcatcgtgtatccgacggtcgcccaaggaaaagcgagaatccgcaccattattacggcggagcatacaaaagaggagcttgaccgggccctggaagtaatccgttcagccgcaaaagagtttcagcttgtgtaagggggaaatgattccctcttttttatttctgattgattcttattctcaataaggtgtacaataataggctggcggttgtgccaaacgcttttaaccagtatacttgagggtggaagtttcggttgaaaggagacattcgaacatgaatgaaaagcaaaagcaggaaagcggacaagtgaatccagcggacaaaacatccgaaaaggattacagcaagtattttgaagccgtatatattccgccttctttaaaagatgcgaaaaaacggggcaaagaatccgttcaatatcataacgattttaaaatctcagaagaatttaaaggcctcggtgaaggcaggaaattttatatccgcacgtacgggtgccaaatgaacgagcatgatacggaagtcatggcgggtatttttatggcgctcggttatgaagcgacaaattcggttgatgacgcgaacgttattttattaaacacttgcgctatccgggaaaacgctgaaaacaaagtgttcggagagctcggccatttaaaggcgctcaaaaaaaataacccggacctgattctgggcgtctgcggctgcatgtcacaggaagaatcagtcgtaaaccgcatccttaagaagcacccgtttgtcgatatgattttcggcacgcacaacattcaccgtctgccggaactgttatcagaggcatatttatcaaaagagatggtcattgaagtgtggtcgaaggaaggggatgtcattgagaaccttccgaaagtccgcaacggaaaaattaaaggctgggtcaacattatgtacggctgtgacaagttctgcacatactgcatcgtaccgtatacccgcggaaaagaacgaagccgccgtcctgaggaaattatccaggaagtcagaagacttgcaagcgaaggctataaagaaatcacgctgctcggtcaaaacgtgaatgcgtacggaaaagattttgaggatatgacgtacggtctcggtgatttaatggacgaactgcgtaaaattgatattccgagaatccgattcacgacgagtcatccgcgtgactttgatgatcatctgatcgaagtgctcgccaaaggcggcaaccttcttgaccatatccatcttccggttcaatcaggaagctcagcgatgttaaaaatgatggcgcgcaaatatgacagagaacgctatctggagcttgtcggaaaaattaaagcggcgatgccgaacgcttcactgacgaccgatattattgtcggtttcccgaatgaaaccgatgaacagtttgaagaaacgctttcgttatatcgagaagtggaatttgacagcgcatatacgtttatttactctccgcgtgaaggcacgccggcagcgaagatgaaagacaatgttccgatgagggtcaagaaagaacgtcttcagcgcctcaatgatttggtgaaagaaatttcagccaaaaaaatgaaggaatatgaaggcaggactgtcgaagtattagttgagggagaaagcaaaaataaccctgacattcttgccggctatacggaaaaaagcaagctcgtcaacttcaaagggccgaaagacgccatcggcaagattgtacgcgtcaaaatcgaacaggcgaaaacatggtcgcttgacggtgtgatggcaggagaagcaatcgaggtgaaataataatgacgctttactctaagaaagacattgtacagcaggctaggaaccttgcgaaaatgatttctgaaacagaagaagttgattttttcaaacgcgctgaggcgcagattaacgaaaatgaaaaagtctctgcgattattaatcagattaaaaccctgcaaaagcaagccgttaacctgaagcactacgaaaagcttgaagcgctgaaacaagtggaaagtaaaattgacgccctgcaggaagagcttgaagggattccgatcattcaggaattcagagattcccagattgaggtcaatgaccttcttcagcttgtcgcacatacgatctcaaatcaggtgacaaacgaaatcattacatctaccggaggcaacctgctgacgggagaaaccggttcaaaagtaaaacattcgaataacagctgttctatttaaacacggggccttcatcggcccgtgtttttttgctatttgagaactaattgtaatatgtactaaattttcatcggctcaccgttttgtcccattttactggaaagttttatcatacttaaaagtaaagtttctgggcagggctgcatacaatgaaacagaaactttgtatttttatatttttattataaaaatgcacatgagacaaatgcccagcataagataacacgaagaagaacaaggaggcctgccggaatgtctgaatacagggaaattattacgaaagcggtagttgcgaaaggaagaaaattcacccaatgcaccaacacgatctcacctggagaaaaaccgtcaagtatattgggcggctggattatcaaccacaagtacgatgccgaaaagatcgggaagactgtagaaattgaagggtattatgatataaacgtctggtactcttacgccgataatacaaaaacggaagttgtaaccgagagagtaaagtatgtcgatgtgattaaactcagatacagagacacaaattacttagatgacgaacacgaagtcattgccaaagtgctgcagcagccgaattgtcttgaagtcaccatttctcctaacggaaataaaatcgtggttcaggcagagagagaatttttagcagaagtggtcggtgaaacgaaagtcgtcgtcgaagtcaatcctgactgggaagaagacgatgatgatgattgggaagacgatcttgatgaagaattagaggacattaaccctgaatttttagtcggagatcctgaagaataagttgaggctaggggagtttaacaccccaagtctcttttttatatataaagatatcactcttttgtttatgttataatgggattcggataagagaagatacatagtgagggattaaatgatggctagttacacgcctatgatacagcaatacttgaagataaaggcagagcaccaagatgcctttttattttttcggcttggtgacttttatgaaatgttttttgaagatgcaaaaaaagcgtcacaagagcttgaaattacactgacaagcagagacggaggttcggctgataaaattccgatgtgcggcgtgccgtatcattccgcggcggcttatattgaacagctgattaaaaagggctataaagtggcgatctgtgagcagacggaagatccgaaggcggctaaaggcgttgtgaaaagagaagtcgtccagctgatcacaccgggaaccgtgatggatggaaaaggcatccatgaatcggaaaacaactttatcgcttccgtttccgaatttcgtaacggatacggtctcgctttatcggacttaacgaccggagaaaacctggccgtatttattgagcggattgaagatgtcatgtcagaaatttactcagtcggcgcaaaggaaattgtcgtatcaagcaagtttaacgaacttacagctgctcagctgaaagaacggtgcggcgccacgatttccatcgaagacggggaaataacagaacgcattgaaatcgcaaagcacttgccgggcgaagagctgacagagacgtttatgcgtttatatacgtatttgcagaaaacgcaaaaacggagcctggatcatctgcagccggttcaagtatatgaattggaagaagcgatgaaaattgacctgtattcaaaacggaatcttgagctgacggaaacgatccgttcgaaaagcaaaaaagggtcattgctttggcttttagacgagacgaaaacagcaatgggcggccggcttctcaaacaatggattgaccgcccgctgatcagggcatcccaaatcgaagaacgccaggaaatggtcgagacgctgatcaatcatctgtttgagcgtgaagatctgcgcgagcgcctgaaggaagtatacgatttagaacgtctggcgggccgggtcgcattcggaaacgtcaacgcaagggatttaatccagctgaaagaatctttaaaacaagtgccgagcattaaagagcttgtagggtctcttaaccataaaaaagcaaaagaacgcgccggcttgattgatccgtgcggagatttgcttgacctgttagaagaagcccttcatgaaaacccgccgttatcgttaaaagaaggcaacttaattaaagacggctatcatcagaagctcgatgagtaccgtgacgccagcaaaaacggtaaagactggattgccagactggagcagcaggaacgcgcttatacgggcatccgttcattaaaggtcggtttcaataaagtgttcggctattatattgaagtcacaaaagcaaaccttcatctgcttgaagacggacggtatgagcggaagcagaccctcacaaacgccgaacggtacattacgccggaattgaaggaaaaagaagcgcttattttagaagcggaaaataacatctgcgagctggaatatgagctttttgccggactgcgtgaaaaggtgaaacaatttattccgcgcttgcagcgtcttgccaaacaaatgagtgagctggacgcactgcaatgctttgctacgatcagtgaaaacaggcattacacaaagcccgtcttttctgataatgaagtaaaagtcattgaagggagacaccccgtcgttgaaaaggtgatggacagtcaagaatacgtcccgaacaactgcctgatgggcgattcgcgggaaatgctcctgattacgggtccgaatatgtcaggtaaaagcacgtacatgagacagatcgcacttctatcgatcatggcccagatcggctgttttgtgcccgcaaaagaagcggttctgccgatttttgatcaaatcttcacgagaatcggggcagcggatgatttgatttccggacaaagcacctttatggtggaaatgctggaagcgaaaaacgcgattgtgaacgccacaaaagacagcctgatcctgtttgatgaaatcggccgcgggacatcaacgtacgacggaatggcgctggcacaggcgattattgaatatgttcacgatcatatcggcgctaaaacactgttcagcacgcattatcatgagctgacggtgcttgaagataagcttcctcagctgaaaaacgttcatgtgcgcgcagaggaatataacggaacggtcgtgtttctccatcaaatcaaagaaggagccgcagataaaagttacggcattcatgtcgcccagcttgccgagctcccggatgatctgatcagccgcgcgcaggagatcttaaaacagcttgagcagtcaggagataaaccggagcttccggcggtatctgagaaaaagtccgccgtcagagaagaaccggcacagctgtccttttttgctgacggtgaaaaagaacagaaggcaccggctgtttctaataaagaaaaacaagtgcttgaagcctttaagtcaatcaatattctcgatatgacgccgcttgaagcgatgaacgaaatgtacaagctgcaaaaaaaattaaaatagaaagaggtgacggacttggcaaaagtcatccagctctcagatgaactttcaaataaaatagcggccggcgaggtggtcgaacggcctgcctcagtcgttaaagaattggtggaaaacgccattgacgcaaacagcacagtcattgaaatcgacatagaggaagcggggctttcgtcgattcgggtgctcgataacggcgaagggatggaaaccgatgattgcaagcgggctttccgccgccacgcgaccagcaaaatcaaagatgaaaacgacctgttccgggtgagaacactcggttttcgcggagaagctttgccaagtatcgcgtctgtttctcatctggaaatcaaaacgagcatcggtgagggagctggaacccatctcattcttcagggcgggaatatcatttctgaacagaaatcctccagcagaaaaggaacggagattatcgttaccaacctgtttttcaatacacccgccagattgaaatatatgaaaaccgtgcatacggagctcggcaatattacggatgttgttaaccggatcgctcttgcgcatccggaagtatcgatccgtctccgtcatcaggggaaaaatctgctgcagacaaacggtaacggggacgtgcgccatgtgctggccgcaatttacgggacggcggttgcgaaaaaaatgataccgctccatgtcagctcgcttgattttgaagtcaagggctacattgcacttccggaaatcacgcgtgcatcccgaaactacatgtcatctgtcattaacggaagatacattaagaatttcccgcttgtaaaagcggtgcatgagggctatcacacacttctgccgatcggccgccatccgattacgtttatcgaaattacgatggacccgattttggtcgatgtcaatgtccatccgtcgaagcttgaagtccgcctcagcaaagagacggagctgcatgagctgatccgtgacgggataaaggaagtgtttcaaaagcagcggcttattccgagcgcccagctcccgaaaaaaacagcgccggcaccggccaaaaacgaacagcaattcataacgttcgaggaaagtgcccctgagcggaaactgccagaaaaaacgccggaaccgtcgtactcgccgatgaagctgagttcggtcgtaaaagagcctgagccggtaataatagaagaagagatcctcccgaatgaatcggatcacggagtgccgccggagatcggtatgcccgaaacggcagcgcctgtttccgatactccggaaccggaagctgtctctgaagaaagagttccggtgatgtatccgatcggccaaatgcacgggacatatattttagcccaaaacgaaaacggcttgtatatcattgaccagcatgcggcccaagaacggattaaatacgaatatttccgggagaaagtcgggcaggtcgagcctgaagtacaggacatgatcgtgccgctcacctttcattacgcggcaaatgaagcgctgatcattgaccagcatcagcatgagcttgaaagtgtcggagtgtttttagaagcattcggcacgaacagctacatcgtccgctgccatccggcctggtttccaaaaggggaagaagctgaactgattgaagaaatcattcagcaggtgcttgacgccaaacagatcgatattaagaaactgcgggaggaagcggccattatgatgagctgcaaaggctcaatcaaagcgaaccgccatttgcgaaacgatgaaatcaaagcgctcttggacgacctgcgccgaacgacagacccgttcacatgcccgcacggccggccgatcattatccaccacagcacgtatgagatggagaagatgtttaaacgtgtgatgtaataacaacgtttatgtgagactaaaccgttatttgcccacaagcagccttactagtttgaatgacccagcctttcagagataacttttgagttttttaatttctggcataattgttgcatcggtatgccgtcaatcatgaaaatgattggtttaacatccagctggttttctgtcatataaaaattgtttttggagagtatttggggttggcgatgtagtatcctgtgtttggtataaccgtctatatcgtcaattgactgcattaatagtaaaataattgtagaaaacggttcctgaaaaatctgtgaagaatttaaatcaaattggaatttggcgggttatactatccgcaagtcagtcaaggggggctagtaattagccccccttttagttcttcctgcggttttttctatttttgatcaaactgaaaaccactaagagaaccacaccgatagcaacaatataaaatgaaatttctgctgctgcggtattaatattcttaagaacaaggataagtcctattaaacctataggaatgatgaaagttagaatttttatagcttttgggctcggttcagcattacttttatgttccatagttacctccgatcttagcactttagaaaataatcactttaaagcttaacacaggataaatttgttaaacaccaacaatagccccgtttaaatgaaaagcctaagagttttagtaatccgccaagcggctgttgggttgccagttcttttagagcacccgcatagcacgcatcttcaactgcaccagtaaaattgtcgatcatattaagaattatttcaaaacgccgattccgcccatagcagctttaactttagcaggtattgcatcccaatctgctcttagtgcttttgcatcccagggcaatttaccttgagcagtaaactccgacccatataacatagtctatttgtctaatgtttaatattttatatttactttttacacttaatgattttatgttagttttgtttttgcacagtaaaaagctgcgcggcgctttcgtgaattgttgcagctagggctgatttgaaaagagtgtaaattacgccgtacttttctaagttcaattatgttaatgtcaacataacgttgaattcggtgtaagaactaaggtattctgatatatttcgagagcccgtatggtttagtttatcttgaagaaaaggattgaaataatagtcttgattgcgggtcatttctaaaaactgattatccccttcggccgcttcggcaattgcttttcaaaacaaaagctcaatttgttttctttttatccgaaacccatattcatccttcattttctgaataaaattacctaaagaattcatctaaattaatattctgatttacttatatatcagcatagcaatttgtaaaaaaggtccagactggtgcttttggcgggagcagaaagtttttttaactttaccggaaaatccatggaaaaacgtggtgtcatctggtaaagtggttacagtcggctgggcggcggcagcagtctgcccggatcttttaaatgggaatggtgacaatggatcatacatatgaagtgcatcaaatcaaaacttatcaccagatgtggtccaactattgttatattatcgcagaccgctcaaaaaaatctgcgatagcggtggacccgtcctgggaaatcgataaaataaccgataaactgcatgaattggatgttgatttatcagctattttattaacacattcgcattatgaccatgtaaacttggcggagccgcttcagcaaatctatcattctgatatatacatgtcgtcggcggaaatcgatttctatcaattccggtgcagaaacttaatagcgcttgaagacggacaaacctttgcagccggagggtttatcatcagaagtatattgaccccggggcatacggccgggggaatgtgctatttgctatctgatcatctttttaccggtgacaccgtgtttacagaagggtgcggtatatgtgaggacaggggcagctcagctgaagatatgtttcacagtatacagaggatcaaagcctccattccgccgcatgtgcgtgtgtatccggggcactccttcggggagaagccgggtcaaaaaatggagagtcttttgaaaaacaatatttactttcagattgaaaaaaaagaacatttcgtgaatttccgcaacagaaaaaatcaaaaagggctgtttcattttaagtagcgtataatttggttctatctaactagtttttcttttggggtacggaacttctgaattgaaatgatagttattgctcgctttttggtgatgaatggctgagtaacggtagtttgcggataaaagcgccgggcaggccgaatgggacattctgcttacgtctgttccaaaagccctgagtccgccttctggcagggaaaaataggcattattcaggattccgcataggataaattaacttgacatggtatttttgtgaagttactatcaacttgaacatgcttcttaactgaatccgagaaaggatggctgagaaaatgatcacatacttattccccggacaaggttctcaaaagcagggaatggggagctcattgtttgatgaatttaaagacttaacggagcaggctgatgaaacactcggatattccatgaaacggctttgtcttgagaatccgtattccaaccttcacaagacgcagttcacccagcctgctttatatgttgtaaacgcgttaagctatttgaaaaaaacccaagacaatggcataaagccggattatgtggccggccacagtttgggagaatataatgcgctgtttgcagcaggtgcttttgattttattaccggccttcagcttgtccgtaaaagaggcgaattaatgagtatggccactgacggaaaaatggccgccgttatggggttaactgcagctcaagtgtcagacgcccttcaaacgaacggattacatacgattgatattgccaatatgaattctcctcaccaagttgtcatatccggacgcaaagaagacattgaaagagccaaaagcgtattcgaaggattaaaagacgttacgatgtttcatccgttaaacgtcagcggcgcttttcactcgagatatatgagcgaagcaaaacaagagttcgaaaaatttttacagtcatttcatttttctgctatatcaattcctgtcatttctaatgtgcatgccagaccttatgagcaagacggaatccactccgttctggccgatcagatcgaccactcagtgcgatggaacgacagcatccgctatctgctggacaaagggcggatggaatttgaagaagtcggcccgggccatgtgctgacaggacttattcaccgcatcaaaaaagaaactgaagcttcacccgccatgtagcggaacgtaagtcaaaattcttatctcacacaatagtgccagccatacaacatcacgaccacttcacctgcacacgacatcacgaaaaacttacaaatcaatattttaaaaaaataaagagcaaaaaggagaacaaatgaaccagccaattgttttcatgttttctggacagggttcccaatactatcaaatggggaaagagctgtttgcacataacaccgcttttcggcagaaaatgcttgacttggacgattttgcagtcagccgtttcggttactctgtcctgaaagaggtttatcatacaggcaatcgtctgtctgatccatttgaccgccttcttttcagccatcctgccatttttatggctgagtacgcacttgcatatgctttggagcaaagaggcatacgtcccgattatgtgatcggagcaagccttggagagtatgcagcggccgctgtgtcgggtgtgctgagcgctgaggatgctttagattgcgtgctggaacaggcccgaatcattacggaaacttgccgtaacggcagcatgcttgcgatactgggtgatccggctttatatcaagatgatccgctgctcggcgaacatagtgaattggcatctgtaaactatcattctcactttgtcatctcgggagagcgggagcatatcaaaaggatcatggacgatctgagagaaaagcagattcctcatcagctattgccggtatcttacgggtttcactcagcgctggttgatcaggcggaacagccgtacaagcgctttttagctcagaaatcaatccggactccatttataccgtacatctccagtgcgacaggagaggctgagaccgatatacaagcggactttttctgggatatcgtaagaaagccgattcgattccgcgaagcgcttcaattcgcagacagccgccaaaaaggattgtatatcgatgccgggccttccggaacattggccgcatttgccaaacagattcttcccgcgggatcggctgaacgcattcgtgccattatgacgccgtttcataaagaacaaacacatttgcagcaaatagaaggcagcattttatcaccgcccggaaggagactgtaagatgatcagctttgtttttccaggccaaggctcgcaaaaaatcgggatgggagaggacctgttcggccgctatcctgaattaaccgcaaaggccgatcacattctcggattttccattcaggagctgtgccgggacggagaacgtctcaatcagactcagttcactcagccggcgctctatgtcgtcaatgccctcagttatttgaaaaaaacagaagaaaccggcttgaaaccggattttaccgccggacacagtttgggcgaatataacgcgttatacgcttcgggagcctttgattttgaagaaggcttacagctggtcaaaaaaaggggcgaactgatgagccgcgcaaaaggaggcggcatggcagcggtgatcggcctgactcatgagcaggtgacggatgttttaagagaaaatcacttggatatgattgatatcgccaacatgaatacaccgcagcaaattgtcatttccggctataaagaagatattgaaaaagccgcatccgtttttgaagccgtaaacggcgtaaaaatggttcaccgcttaaatgtcagcggcgcctttcattccagatacatgctggaagcgaaggaggaattttcacggtttatcgaatctttccattttaagccgctgtccattccggtcatttcaaatgtgacggcaagaccctatgagcagagagagctgaaagagacactcaccggacaaataacgggatcggtgaactggacagacagcatccgtttcttaatgggaagaaagaacatgagctttgaggaaatcggtcccggaaaagtgctgacggggctgatccaaagaattacggctgaagcggagccgataacagatgaaatcaaagtcccggctgaggctggaaaaagctcaattacggcggcgtctttaggaaatgaagagtttaagcgcgattatcaattgaaatacgcctacttggccggcggcatgtaccgcggaatttcttcgaaggaaatggtcgtcaaactggccgaaaaaggaatgatgggttttttcggaacgggcggtttgaacatcgcgcacgtcgaggacgccattttgtcaattcagcatgagcttcgtgacggcggttccttcggcataaatattgtacataacatgaagcatacagattcagaagaaaaaatgattgatcttttattgaagcatggggttcagaacttggaagcatcagcgtttttagcggttactcccgctttagtaaggtttcgcgctaaggggttaaaacgcgatgccggcggacaaataatagcgcgtcagcggattatcgccaagctgtcccgtccggaagtagcggaagcgtttctcagcccggcgcctgatcacattcttcagaaacttgcagccgaaaacaaaattaccgctgaagaagcaagtctgatgagagaaatacccgttgcgcatgacatctgcgtagaggctgattcaggcggccacactgacggcggagttgcttacagcctcatgccggcgatcatccgtttacgagatgacatgatgaaaaaataccgatacggcaaaaccgtccgcgtcggagccgcagggggaatcggaacgcccgaggctgccatggccgcatttatgctcggcgctgattttattgtgaccggatccattaaccaatgcaccgttgaggcagcgacgagcggcctcgtaaaagacctcctgcagcagatgaatgtacaggatacggcctacgcgccggccggcgatatgtttgaatcaggcagcaaggtgcaggtattaaagaaagggctgttctttccgacccgctcctctaagctgcatgaactgtatcagcgtcaccgctcaattgaagaaattgatgaaaagacactcagacaaatagaagagaagtattttaaggcaagtgtaagcagtatttatgacaaagtgaaggctcattattcgaatgaagacatttcaaaagccgaacggaatccgaaacagaaaatggcgctcatattcaaatggtatttcaggcaaagttctgcttcggcgattaaaggagacccggaggccaaggtagacttccagattcattgcggcccggcattaggcgcctttaatcaatgggtgaaaggtacggagctggagtcctggaaaaaccgccatgccgatgatatcggcctgcggcttatggaagagacggcctcgcttttgaatcagaagttaggctcatttctgcaaacgtgttgacaagacgaaatgatagattgaaaacatggaatattcataaaagatgaaacagggaggaactgacaatgagtgaagaaagaatctttgaattgttgcagaacacaatctacgaggttttgcctgatttagaaggcgaacagctttcacaggaagaccggttagttgatctgggggcggactcagtggaccgcgccgaaattatcacgatgatgcttgaagaattatcactgcagatcccgcgtgttgagctgacgggagtgtcaaacatcggcgaattggcggcaaagctttatgaaaaggtacaggctgtctgataaaacggtgaaaaaatcggaaactcaaaattcatattggaggcgaagttcatggcggctgccggaatagaagcgataaatgtgtttggcgggacggcataccttgatgtcatgcagctggcggagtacagaaacttagaccctgccagatttgagaatttactgatgaaagaaaaagcggtggcgcttccgtacgaagaccccgtcacattcggcgttaacgcggcaaagccgattatcgaccgattgacagaggctgaaaaagacagaatcgagctgctgattacctgctcggagtccggcattgacttcggaaaatcactcagtacatatattcatgattacttaggcctcaaccggaactgccgtttatttgaactgaagcaggcctgttattcaggaacggcgggtttgcagatggcgcttaactttattttgtcgcagacatcccccggagcgaaggcgcttgtcgtcgcgacggatatttcccggtttttaattgccgaaggcggcgatgcgttaagcgaggattggtcttacgccgaaccgagcgccggagcgggtgccgtcgccttattgatcggtgaaaatccaattgtatttcaggcggatgcgggcgctaacggctattacggctatgaagtgatggatacatgccgtccgatcccggacagtgaagccggtgacgccgacttgtcattgatgtcttatctcgattgctgtgaacagacatttcgcgagtacaaaaaccgtgtgccgggcgctgactacaaagagacgtttcactatcttgccttccatacaccgtttggcggcatggtcaaaggggcccaccggacgatgatgcgcaagcttgcaaaagcgaaaaacgctgaaatcgaacaggattttcaaaccagggtagagccggggctccgctattgccaaagagttggaaatattatgggagcagcctctttactggctcttgcaagcacgattgaccaaggggcattcgacacttctaagcggatcggctgtttttcgtacggctccgggtgctgttcagaattttacagcggcgttgtgacgcctgaaggacaaacgcggcagcattctttcaaaatagaagagcacctgaacaacagatacaggctgtccatggaggagtatgaagaattgtttaaaggcagcggtctggtgaagttcggaaccaggaatgtcaaattggatatgaatatggtgccgaacattttagaccatcatacaggaagccctcgtttgtatttggaagaaatcacggaatttcatcggaaatacaggtggatatcgtgacctatgaaacgataaacgtccgttttcagcaaaatgtctgcttcatcacctttgatcggcctgaagccaacaatacgattaatgagcgtttagtggaggaatgcctgcacgttctttctgaatgtgaagactccgtgacctccgtagtgcttgaagggcagccggaggtattttgtttcggggcggattttgatgagatgtaccggaaaatgaggcagggaatgcagcatgcggaatcgcaggagccgctttaccgtttgtggctggcattaaaaaccgggccgtacatcacaatcgcccgcgtccgcggaaaagtaaatgcgggaggtgtcggttttgccgccgcgtgcgatatcgtcattgcagaggagagtgcttcgttcagtttatctgaactgttattcggactttatccagcctgcgttctgccgtttttaattcaaagaatcggatttcaaaaggcgcattatatgacgattatgacaaagcccgtgccggcacgccaggcgcttgaatggggactttgtgacgtatgtgtcccggactcagcaacagagctgagaaagcatttgctgcgccttcgtccgctgtcgaaaaaagcagtcatccgctataaaaaatacatagattccttaaacgaccttgttcatcgttcgaaatccattgctttagccgaaaatcaagcgatgttttcagatccggataaccaatcagccatcacccgttatgcagaaacgggacggcttccttgggaaacggagaacagttaggaggatatcatgccgaacaccgcagttgaactgctagaaattgaaccggatattatccaagtgacaatgcaggataaagcccataaaaacgccttctccaaagaactgacggatggattgatggaagcgttcacccgtataaaaaaatcgtcagtctataaagctgtgattttaacaggatacggccattactttgcttccggaggcacacaggaaggcctgctcaggattcagcagggcatcacgaagtttacggaagaccgcatgtactctttggcgctggaatgtgatattcccgtcatttccgccatgcagggccacgtttcacgggccgagcatggcggtcgatacggtctgttcatcttcgctgactgcggttcaccttgctgcggaaagcattcggcgcggggaatgtgaatcggcagttgccggaggcgtcaacttgcttcggttcattgtcaaaaactttgtttttcgaatatcagaatatcgaatcgctggcgcagtattttatgaaagcacaccgggacacgctgctggaagtgaccgggatgaaaacagaagaaacccctgcagccaaaccggcgctgtctgagaaagcgaaagtaaagcccgtttccaaacggaatgaaggcaaaaaaggctttgcgcatgtccgtccagacacgcggaaaaatcagcagctgacggagcgtgaagatatcgcgattatcggtatgtcaggacgatatccgcaggccgaaaatcttcaggaattttggaagaacttgagtgaaggcactgactgcataactgaaattccaaacgatcgctgggatcacagtctttattacgacgctgataaagataaagaaggcaagacgtacggaaaatggggaggatttttgaaagacgtggacaaatttgatccgcagttcttctctatttcgccccgggatgcaaaattgatggacccgcaggagcggttattcctgcagtgtgtctacgaaacgatggaagatgccggttacacgcgcaaaaagctcacggaaaaatcgggtgatttgcttggcgccaatgtcggtgtttacgtcggcgtcatgtatgaggaatatcagctttacggagcagaagaacaggcgcgcggaaaatcgcttgcgctgaccggaaatccgtcatcaattgcgaacagggcttcctatgtattcggttttaacggtccgagcatggcgctggatacgatgtgctcttcttctttaacagccattcatctggcatgccaaagcttgcggaacggggaatgcgagacagcatttgccgggggcgtcaatgtatccgttcatccgaataaatatttgatgctcggccagaacagatttttatcaagcaaaggcagatgtgaaagtttcggtgaaggcggggacggttatgtgcccggtgaaggagtgggagccgtactccttaagccgctttctaaagcgaaagcggacggtgatcatatttacggcctgatcaaaggaacggccgtaaaccatgatggaaaaacaaacgggtattccgtaccgaacccgaacgcccaagccgcggtgatcaaacaggcgttaaaagacgcgggaaccgatccgagggcggtcagctacattgaagcccacggcaccgggacttcactcggtgatccgattgaaatcacgggtctgacaaaagccttttcagaacaaacacaagataaacagttttgtgccatcggctcagcgaaatccaatatcgggcactgtgaaagcgcggcgggcatcgcgggtctgacgaaggtgctcctgcaaatgaaacataagaaactcgcaccgtcactgcattcccggacgcttaacccgaatattgattttctcgctacgccgtttaaagtgcagcagacgcttgaagagtggaaaagaccggtcataaatgaaaaaggagtaaataaagaactgccgagaaccgcagggctttcctcatttggagccggcggtgtcaacgctcatatcgtcatccaagaatataccgctgatgaggataaggagacggctttcgccacgcctcatccgtcgatgatcgtcctttccgcgaaaaatgagaaacggcttcaaaaacgggcggaacgtcttcttgatgcgctgcggagcgggcgttaccgggaagcggatctgagccggatcgcctatacgcttcaaatcggacgtgaaccgatggaagagcgtctcggaatcattgtcagcaatttgcgcgagcttgaagaaaagcttgacgaatttacgggcggcaaggagtcaattgaacggctctaccgcggacaagtcaaacagaataaagacacgatggcgctgtttgcggctgatgaggacatggaaaaaacaattgaggcatggcttgaaaaaggcaaagccgcaaaggtattagagctttgggtgaagggccttccgctgaattgggataagctgtatcaaatgggcagaccgcaaaaaatcagtctccctgcctacccgtttgcaaaagaccgttattggatcgacacatcagctgatacagctgtcaaaagaccggccgaaacacagtctgcgccgatcgcaccggcggccgtcccggaaccggtcattgaagtaacaactcttcacgaggagactgccaaagaaaaaccgtcaaacatttcattgcagcctttgagcggcgcgaaaccgaaaagaaccgtacagtctgtttcccgtccggcggtttccgctgagaaagtaagtgccgtattgaccgaaagtttggcagacgttttatatatggatgccgacgatatcgacgcagacgacacatttattgatatcggcatggattcaattaccggtcttgaatggataaaggctgttaataaaacgtacggcacgtcccttacggtgacgaaagtatatgattatccgacaattcgccagtttgcggctttcttgcaaaaaaagctcgggacagaaccgatccttgaggaagcaaccgaaccgcagaaaacagaggccgtgaaaaaaccgtcaaacatactgctgcagcctttaaacgctcataagcagcatgtgatacaagcagaagcggatattctggaggcgatgtctgaaacggcagcttccgccgaaccggaagaaccgattgaagcggtgcatgacgagttatcaaaagcactggctgatgtattgtacatggagcggcatgaagtggatattgatgaggcctttattgacttgggtatggattcgattaccggtcttgaatggataaaggccgtcaataaacggtacggcacggactgtaacgtaacgaaagtgtatgattatccgacaatccgccaatttgccgattttctgcgtacgcagccgtccgtccgcggaagaaaaaaacaggcggttcccgtacgtccaaagccgcttacacagcaacacgccctgcaggagaaaacacctgccgagcctgagagattaacggttcaaaaggaacctgaaccggtgcaggccaaacgggagcctaaagacgagatagcggacgcgatagccatcgtcggcatgtcgggcaagtacccggatgcgccggacctaaagacgtattgggacaacttagcccgtgcgaaaaacgccattcgcgacatcccgctttcccgctgggatgtagacaaatactatgatccggccttaaacaagaagggcaaagtatactgcagatcaattggtatgcttgacggcattgaagaatttgatccgctgttctttaatatttctccgtctgaagcggaacttatggacccgcagcaccggatatttttacaggaaggttttaaagcctttgaagatgcgggttacagctcaaaagaattaaacgggaaaaattgcggcgtttatttggggattatgaacaatgaatacggcttgatgttaaacaaccatcagacaggaggaagcgcgacgggcaacagtttcagcatcgcggcggcccgcctgccttattatctcaatttgaaagggccggccattccggttgatacggcatgctcttcatctctcgtcgggactcatttggcgcgtcaggcgctgttgaatcatgaaattgacatggcgcttgtcggcggcgtgaccttgtatttaacgcctgaatcatacatcagcatgtgtgaagccggaatgctgtctcctgacggccaatgtaaagcatttgataacagtgcgaacggatttgtgcccggcgaaggcgcgggggcgctcgttttgaagaggctgaaagatgcggaagccgatcaagaccatatttacggagtcattatcggatctggaattaaccaggacggaaaaaccaacggcattaccgcaccaagcgcgaaaagccaaatggatttagagcgccaagtgtatgaagcgcacaacatccaccctgagagcatcacctatgcggaaatgcacggcaccggcacaaagcagggggatccgattgaattagaagccctgtcttctgtatttaaggaaaaaacggatcgcaaacaattttgcgccatcggttcggttaaatcgaatatcgggcatacgtcggcggcggcaggtgtagcaagcgtccagaaggttctgctgtcgatgaaacatcagcagcttgtaccgacccttcatttcagcacgccgaatgaacattttgatttcgatgactcgcctttatttgtcaataccgaactcaaaccttgggaaacagccggagcaccgcggcgggcctgtgtcagctcattcggctacagcggcacaaacgctcatctcgttatcgaagagtatcagccgaaagaccggggaagccgtaagcctgatgagacaaacatttttgtgctgtcggcgaaaaaagcgccccaggtaaaaacctatgccgagtctgtgatcgaatttgcaaaagccaatcagaatatcaatctttcagatatggcgtacacgcttcaaaccgggcgtgatgcgatggattaccgtcttgcagttacagccggttcgagagaagaactgatcagccgtttaaccgattttgtaaacggaaatacgggtgaagggatatatgaagcccacattaaaacggcaaaaaaagaaatcaaagcatttgaaacggacgatgatctgaagcagcttgtcaggtcgtggttcgataagaaaaaatacgccaaaatagcggaattgtgggccaaagagcttcagatggactgggacagactctatcaaggcgaaaaaccccgcagaatcagtctgccggcttacccatttgcgaaggagccgtactggctgcctgagccgaaagccgtaccgcaggaaacagaagaccggcgcaaggctgtgcttttagataagcaatgggttccgtgtgagatcgattcggccggtgagaaaagcggcaggacggtcatgattctggctgatgaaagaacagcggagctagccgaagagactgcgaagcatttcactgactcgttcattctcccggtcgattccgctgacactgcagctggcgattggaatcacatagatggcgcaatcgatctgacgggatgcggagacgaagacccttcactgaaagggatcagccggctccagactctgattgatacaagccgccggcaagcgcggccgctgacgctgctatatgtaacaaaaggattggagccatttcagcagaaaacgattcatcttgcaggagcggcaaaaagcggcctgtacagaatgcttcaaaatgagtatcaaaacgtgacgtcaagacacatggatgccgatacagatacggatcagcagacgcttgccaaacagattgcagatgaattttcggcggacagcacagaaccggaaatctgccgccgaaacggacagagataccgtgctttattcagggagattccaagcgggaagcgggcagaacataagcccgcaccgtttcctgaagaccatgtgcttttcattaccggaggcacgaggggactgggtctcttatgcgcccgccatttcacagaaaaacacggcgtgaaaaaagtagtgctgacaggcagggagccgattcctccccgccatgaacggtcagccgttaatacgaggctgaaagagaagatacgggcgattgaagagattgaagcaaaaggagtgcaagtggcggtgatcagtctgaaattgtctgatcatgatgcggcggcagcggaaattgaaacgatccggcgcacgatgggaccgatcggcggcgtcattcactgtgcgggatcggttaattcagtaaatccggcgtttatcagaaagactgccgacgatatacaagaagtgctggaaccgaaagtcgcagggcttcaaacattaagcagccttttcacaaatgatcctttgcaattttttgtcttattttcttcagtatctgcagtcgttccggcgctcgcggcgggacagtcggattatgcgatggcaaatgcgtacatggattatttcgcggcggctcatcagcatcaatatccgttagtcagcattcaatggccgaactggaaggaaaccggattgggtgaagtccgcacagaaagcctgaagcagaccgggctgctgggactgtccaacgcggaaggacttgacttgcttgaccgcattttatctgaaaacatccgcccgtccgttctgccggctatcattgatcggagcgaatggcatcctgacaggctgctctgtcaagagaaaacacaaaaagagactgaagccgtaataaccggcaaagccgcggaaaaacattcagacagagaactgcttcttgatacgaaggcgtggcttgtgaaattgttttccgatgagctgaaaatcgctccggaagaactggaaacagacgaaccgtttcaggattacggggttgattcgatcattttagcgcagcttttacagcaaatgaatcaagcgctcaaaagaggacttagacccatctgttttatatgaacatccgacgattgacgcgtttgccgaatggcttgtatccaatgggcagccgctgcttgcagaaagggaggaacctgatacagaaatcttggttccggctgccgtacaaacggttcacactgaacaaaagcgtgatgccgtaactgaagacattgccgtcgtcggaatgagctgccgttttccgggagcggaatcgttagaacaatattgggacttgctgagaagcggcaggtccgcaatcggctccgtcccggcggaacgtttcggatatgcaaatcaatacgttgcgggattgattgacaatatggatcactttgattccgaattctttttcattccggaaaacgacgcgaaagcgatggaccctcaggcgttggcggtgttggaagagagcttgaaactttggtgccatgccggctatacccgtgaagaaatcaagggcatagaagccggtgtgtatatcggaggccgcagccagcatcagcctgatcctgaaagtcttgcgaatacccgcaacccgatcgttgcgggcgggcagaattatttagcggcaaacgtttcgcaattttttgatctgcgcgggccgagcattgtgcttgatacggcttgttcatcggctttgacaggaatgaacatggccgttcaggcactgagaagcggcgatatcaaagcggcggtagttggcggcgtcagcctgctgaacacggatgcggcgcaccggatgttccaagagcgcgggctgttaaacgaaaaaccggcatttcacgtatttgacaagcgttcaggcggagttgtcctcggtgaaggcgtcggcatggtgctgttaaaaacagtaagccaggcgcaaaaagacggcgacacgatacacgcagtcattaaggccgccgccatgaacaatgacggcagaacggcaggcccgtcagcccctaatatgcaggcgcaaaaagacgttatgcaaagcgcgcttttcaaaagcggcaaaaagccggaagacatcacttatatcgaagcaaacggatcgggttccgcggtgactgatttgcttgagctgaaggcgattcaatccgtataccgctctggccagcatgttccgctcggcatcgggtcaatcaagccgaacattgggcatccgctttgcgcagaaggcatcgcaagcttcattaaagtcgtattaatgctgaagcataaacaaacggttccgtttctctcaggagacgaaccgatgccgcattttgatataacaaagacagattttcactttcataaaacagccggcgaatgggatgcagccagaccgtcagcagccatcaactgctttgccgacggcggaacgaacgcccacgtcattctggaagcttgggaagaaaaagatacccgaatgaaaagaaagccgctgccggtaccgtcattaagacgtaaggctctggtaaaagaatctgacgtacgagcggagaaacaagagcttcctgcgaaaaaaatgttttggaaagcatttaaatgagagaggagtgggaaggaatgatatcggaaaaaatcaatatctcactggatcatcccatcatgaagggccatatggtctttggtgaagcggtattgcccggtcttgcttatatcgatttgatttatcaggtttttcaggaacacggttatgtatacaatgagctcgaattgaagcacgttacgatttatcagcctttaaccgtcagtgaaacggctgcaatcattctgaccattcaatgttctgatagcggagatggaaagtggctcatctccctttcagggcagaaacagcaaggtgacgagctgtcagacaatatacaatatgcgacggctgaaatggtgaaaagagacgctgtcacatttgacgaaaccattgatttcggcgatgtgaagcagtcaggcagatctctgaatcttgatgacatgtataaccgctgcctggatcatgacttggttcattccggcatgatgaaatcgaacggacgattgtacgaaacagaaggcggcatgctggctgagctttcttgcgaagaaggaaaagatttctttttattccatccggcccttttggatgcgagcggaatcggggcgagcggtttgctttctgaaacaaaccggcttcacctgcctttatattatgaatcgttcacggccgccgacaggctgcaatcagagtgcacggcgcgtatcgccgcttccggcgtccgtcaggaaaaagaactcacaacgatgacgatcgagtacttcagccgatccggacaaaaggtggcggagcttaaaaacattacgggaaaagcggttcggctcgaagaagacgcgaatacagccgaacagaatcaacaggctgcaactgagccggaaagcacagatgaaaaagacatcattctgtttttaaagaagcttttggctgataagcttggtcagccttgggagacgctggacgttcttgcaggctactatgagcttgggctggattcatcttctttgcttgagattgtacaggatatcagtaaaaagacgggtgcggacctcgcgcccactcttctctttgaatatacaaatataaaagaactcgcagcctttttgaaaaagaccgtttcatttgaatgtgcggaacgtgcagccgaaccatcacggtctgaagctgaagcaccggacgcgccagaacatcataaaaacaccggagacatcgcgattatcggaatggccggccgctatccgaaagcgaaaagtgtggaggagttttgggaaaacctgaaggcaggcacggattgtatcactgaagttccgaagtcccgatgggattggcaaacatataaaaacgtaacgtccccgtcaggaaaaacagtatcaaaatggggcggtttcattgacgatgccgactgctttgatccgcagtttttcagaatctcaccgcgtgaggcggaaacgatggacccgcaggagcgcctgtttttagaaacatgctgggaaacgattgaagatgcggggtatacgcctgaaacgctgggaaataaaggggagaaacagcatccgatcggcgtatttgcaggggtgatgcataaagattattccttaatcggcgtagaacaattatctgaaactgatccttttccggtttcactgaattatgcgcagatcgccaacagagtgtcctattattgtgacttccacgggccgagcatcgcggtggataccgtttgttcctcatcattgaccgccgtccatctggccattgaaagcatccgccgcggcgaatgtgaagccgcgcttgcgggaggggtgaacttgtcgctgcacccggcgaaatatctcagctacggaagcgtgggcatgcactcaagtgacggccgctgccgtacattcggcgagggcggggacggctacgtttccggagaaggagtcggtgcggtattgctcaagccgctggaaaaagccgaacaagacggcgaccgcatttacgcggtcattaaaggaagcgccgttaaccacgtagggaaagtaagcggaattaccgtcccgagtcctgctgcacaggcagaagtcattaaggcctgtctgaaaaaagcaggtatcagcccgcggaccgtcagttatgtggaagcccatggcacgggtacttcgttaggagacccgattgaaattgaaggtctgtcaaaagcgttcagccaagggacgcaggatcagcaattttgttccatcggttcggtcaaatcaaatatcggccacgcagaatcagcggcggggatcagcgggttaacaaaagcggcgctgcagcttcatcacaaaacgcttgtcaaatcactgcattctgcggaattaaatccttacctgaaatttgagggatctcctttttacgtacagcagcagactgctccgtggaagcagccggcagccgaagaaaacggtaaagtcacacattatccgcgccgggccggactcagttccttcggtgcatcaggttcgaatgcccatatcattttagaagaatacattcagcctgaacaaaaagcgcctgcacctgagaacgatgcagcaaaactcatcccgctgtcagcaagaaataaagacaggcttctggcctatgcggaaaaactagcccgatcgctttcagaaaagacggtgctgtctgaactggcttatactcttcagacaggacgtgaagcaatggaggagagagctgtcttccttgtaaatgacacccgcgacttgaaagaaaagctgaatgatttcgtaaaaggaaacgaaaacatccccggtctttggcgcggacaagccgagctgccggaactgagcgaacccgctcccgagacggatgatccgagacggcttgccgagttatgggcagaagggaaaacagtagattggaataagctgtacggttcatataaaccgcgtaaaacaagcgttccgacgtatccgtttgcaaaagaacgctattggattccgcagcagaaaaaacaggagaaaagcccgtcaggaacagtgctgcatccgcttttacaagaaaatacgtcagatttttcgcagcacgcttcacgtctctttttacgggagatgaatttttcctatctgaccatgtcgtcaacggacaaaaaatactgccgggtgtcgcctatttggaaatggccgcagaggcggtcaaaaaggccgctgccgtgaaggaaaaaggccatagcgtcacactcaggcaggttgtttgggtccgtccggtcatgattgaagacaaaccgaaagaaatacatattgccctttacccagaagataatggtgagattacctatgaaatatacagtgaggcggaaaacgacgaagatccggttattcacagccagggtgaagcggtcattaccgaacagggcagcgcccagatagatatcgagtctgtcaaagcttcctgcaatttaggaatcgtgactgcggaagaatgttacggtgcttttgagaagatcggtctggattacggagaggcatacaggggcgtacagcagttgctgcttggagaagaccgattattggcccgtatttcactcccggctgccgtacatgacaaaaaagaacagtatacgcttcacccgagtatgatggacgccgcttttcacgcctccgtcggtctgcttgtccggtcgatacatgacgatgcagacagccacgagctttctttgccgtttgcgatgcaggaagtggaagtgtacggaccgtgtcctgaacatatctggtcatatatccggtacacagaaggcagcaaagcagatgacagcgtaagaaaatttgacattgatatgtgtgatgatgccggtacggtttatgtccggatgaaaggcgcgtccgtccgggcgcttgacacaggccaaacagcgggcggagaaacctcggaggcgcctgtcggccatacgatgctgattccggcttgggagcctgttgcgcttgaaaaagccggggaagcagcggtggataagcagacggcagtattcagcggaacggattcgagacatacgcgcataaaagaacatctgccgaacgcttcctattatccgatcagaagcacggatgatatcgcatctcttacgcacatgcttgaaggacaaaaagaactggagcaaatcatttggcttgctccgcaggctgagagtgctgacagcctcaaggaacaggaaaggaacgttcttcatgtgttcaagctgatgaaagcattacttgccttagggtacggagaaaaacgtttggactggtgcatcgtcacagcaaatgcccagccgttttcggatcaagacagcgccgacccgtcacaagccgcagtcagcggacttgccggaacaatggcgaaagaatatccgcattggcatatccgcatgattgacacagaaacggacggcagctggccgatcgaagaggcgctcagtctttctgccgggaaaaacggtcaaatttgggcgtaccgcaatcagcagctgtttgagcggcagctgatcccgcttgacaatatgccgacaaacggcacgctgtaccaaacaggcggggtttatgccgtgatcggaggcgcggggtatcttggcgaggcatggagtgaatacatgatccgccgctacaaagcacgcatcatttggatcggaagaagcacactgaatgattccatacaggcgaaactcgaccggctcagcgcattcggcccggcgcctgaatatgtttccgccgatgccgctgacagttcttccttagagcgggcttatcagttcataaaagagcgccacacaaaaataaacggcgttatccactcggcaatggatctgtctgagcaaagcttaaataatatgaagacagaagagttcaaatcggtgctgcgggcaaaagccgatgtaagtgtgtccatggctgaggtattcggacgggagccgcttgactttgcgctcttcttctcctcgcttgtggcatttattcataatgtgaaacaaagccattatgccgcaggatgcgccttcagtgacgcatttgcgaaagaacttgctcagaaatggaactgcccggtcaaagtcatgaattggggctattggggcaacagcgaagcggctgaagacggcaattttattcagctgatggatcagatcggattgggattgatcgaaccggacgctgcgatggaggcgcttgaaacacttatgacgatgccggttgatcaagcagccttcattcatacgacaaaaccggtcgcagtagaggggatgaatgaacgagaaacgatttccgtttatccgcctcagccgcttgtaaccggacaacagccgaaggccgctccgcccggcgcacgtcttgtaagaggggctgaacatcaggagcttgatgattttctgtatcagcttttgatcgcccagcttaaagaagcagacttgctgacgccgcaaagccttaaagcgtatgagcctgaacacgaatattttaaaaaatggctcgatcaaacgatcaccttccttctggaacacggctatctggaagggaatgccgattcatttacactgtcagcccgcgccgaaaaaacaaccgcctcgctatggcgaaaatgggagcaggaaaaagcggaatggctcaataacgctgatacaaaagcgatgactgttttagccgagacgatgcttaaagcactgccggacattctgcgcgaagacgtgccggccacggatatcatgttcccgcactcttcaatggaacttgttgaaggaatttataagcacaatcaagtcgcggattactttaacgacgccctgtcagatacattaacggcctatgtgaaagaaaccatcagtaaaaactcaaaaactgccatccgtatactggaaatcggagcgggcacaggcggcacaagcgcaggcatatttgaaaagcttaagccgtatcaaaaccatataaaagaatactgttacaccgatgtatcgaaagcttttctcgtgcatgcggaaacagaatacggcaaacagaatccttatctgacttataaactttttaacgcggaagcgccgctttccggtcaggacatagagccgggcgcatacgacatcgtcgttgcggccaatgtgcttcacgcgacgaaagacatacgccagacgctgagaaacgccaaagccgttttaaaagacaacggcctgctgctcttaaatgaaatggcgggaaacagcctgttcccgcatattactttcgggctgcttgaaggctggtggctgcatgaagattctgaccttcgtattccgggatgtccgggcttgtatccaaaaagctggaagcgcgtgttagaaagcgaaggctggcattctgtctatttcccggcagaagcggcacatgatttaagccatcagattgtagcggcaaaaagcaacggcattgtccgccaaaaaacgcttaaagcaggaggcgtaacaccggccgcactgccaaaagcagcacaagcgccggaacttcagccgcaaacaacggccgaaaaaagcgatacagctttaacagaaaaaagcactgagtacttaaaaacgttaatcggagaaacgttaaaaattccgccggctcaaattgatccgaaagcgccgcttgaaaaatacggaattgattctatcgtcgtcgtacagctgacaaatgcgttacgaaatgtgttagaccaagtcagcagcaccttattttttgaatatcagacgatcgaggctctcgtcggccacttaatcaaaacaaaaaaagccgcgatgatcaaactgacgggacaagcgcctcttcatgaagaaccagaggcggcatccgaaccgcaggctgtacagccggctaagccgcttcgcactgactggcggcggagagaaaaacgggcagccaaagaggccgtccggcaaagttcggttcgcgacgtggccatcatcggcgtttcaggacgctacccgcaggcaaaaacagcggctgagctttgggctaacattaaaaaaggaaaaaactgcatagaagaaatcccgcaggaacgctggaactggcaggattactacgatgaagaaaaaggtaaagagggctctatttatacgaaatggggcggattcattgaagatatggacaagtttgatccgctgttctttcagatttctccattggaagcggagcgcatggacccgcaggagcgattatttttagaaacggcgtatgcgagtatcgaggatgccggctatacgcctgacaacctgtgccaaagcagaaaaatcggtgtttttgccggcgcgatgaacaaaaactacccgacaggctacggctactggtccattgccaacagggtatcttacctttttgatttccaagggccgagcattgccgttgatacagcctgctcttcttctttgacggccattcatctggcgcttgagagcatatacagcggttcaagcgaatgcgcgattgctgggggcgtaaacatagtgaccgatccgatccattatatgaatctgtcagtcatgaacatgctttccgcaggtgacacgtgcaaatcgttcggagaccgcgcggatggttttgtcgacggagaaggggtgggcgcggtcgtgttaaagccgttagaccgagcgattgccgacaacgatcacatttacggtgtgattaaaggaagcaccattaacagcggaggcaaaacgaacggatacacggttccgaatccgaatgcgcaggccgccttaataaaagaagctttcgaaagggcaaacgttccggcgcgcaccgtcagttatattgaagcccacggtacgggcaccgcattaggagacccgattgaaatcgccggattaacgaaagcatttgaagaggatacaacagacaaacagttttgcgccatcggctccgcaaaatcaaatatcggtcattgtgaaagcgccgcgggcattgcgggtctgacaaaaatattattccagctgaaagaccgccaaattgcgccgtccctgcacgcggaacagctgaatccgaatattgatttcgcgtatacgccgtttgccgtacagcaggagctcggtgagtggaaacgtcccgtcatcggcggcagagagcttccgagaagggcggggttaagcagcttcggcgcgggaggagcaaacgcccacctcgtcatagaagaatatacggcagacaaagagcctgatgaaacgctggcagatcagcccgccatcatcgtcctgtccgcgaaaaacagcgaacggctcactgaaaaagcaaaacagctcagagacgccatccgtgaaaaaagatacagcggcagcgaccttatgagcatagcttttactctccagacgggccgggtgccgatggaagagcgtctcggctttatcgttcattcacttcatgaacttgaggaaaaactgaatggatttatcgccggacaaaacagcgccggactgcaccgtgacggcacggaagaaaacaaacggatgcttgccgtattttcggcggatgatgatatggaaacaatcatagacgcttggatcagcaaacggaaatattctaagctgctgagctttgggtaaaaggattggacatcgattgggcgaaattatacggagaccgtcctccggcccgcatcagcctgcctgcttatccgtttgcgaaagaacgcttctggcatcagcagcctgtacaaagcaaggccgcgcccgttaacgcgccggctgacgaaaatgatccggcggagcagtttgaagtaatgacttttagagaagttcttaaagaacaggctctgccggcagccggagaaaagcaagtcaaaacggtgatttctttcttatctgatcagaagaagcagcaggaagccgtctctgtggtcaaatcgtatgacagtgacattgacgttatttttatcgctcagggagaccggcatgaggctctgtccgccggccgctgccaagtggtgcgggaagatccgcaatcatatgtgaacgcttttgcggatattcaaaaagagtacggtgaggcttctgccattttgtatttatgggcgcttgaagataaaagctgcatcgaagattattcatgtatcgttcatattcttaaagcaatggctgagaccggtctgcagccggaaaggctgttattggcgggggaatatgcatccggtctggaaaggtgctacttggaatcatggatcggctttgagcgttcgctcggcattgttctcccgaaaacaagtgttaccggccacttcagaaaagccggtgcggccataacggactggatgagaaccatttgggacgagctgaaagctgaaacagaccatactgttttcttggaagagggaaaacgatatgtctatcacaccgaaccaaccggactaacgaaagaaaacagcaggatcagaaccggcggaacatatctcattacaggcggattaggagggctcggctacttatttgcccgccatctcgcccggaactaccaggcaaatgtcattctcacggggcggtcgccgatcaatgaagaaaagaaagaaaaaatgaaagatctggaaaatctcggcgcgggtgttctttacgccgaagccgatgtttgtgatccgatcggaatgggcgactgcatcaagcgcgcgaaagaacgattcggagccattcacggcgtcattcatgcggcgggcatcgaaagcagaacatccgtctttgaaaatgaaatcgggaatttccgcagtacgcttgaaccgaaaataaacggaagcctgcttcttgacgagtggctgaaaaacgaaacgcctgatttcatctgctacttttcatccacatcggctgttttaggggatttcggctgctgtgattatgcggtcgcgaacaggttccaaatggcgtatgcccgctataaaaacgaacaatccgaaagcggaaacgcttttgtcataaactggccgctctggaaaaacggcggaatggccgtcggcggtgaagagacgacgggcatgtacctgaaatcaagcggtcagcgcctgttagaaacagatgaaggcattgagctttttgagcgcatcatttctcaagacaacacccagtgccttgtcattgccggcgaaagaagccgtgccgaacgatttttaggcatacggcgggacgattcattaaaaacggatgcgcttttggaaaccgtgagccgccgcatcccggaagaaagcgcggaaaaacggctcgaagcggatttgaaagagctgatacacagtctgctgaaaatatccaaagataaactcgtcctgcataaaaactgggcggaattcggatttgattccatctatttagccaaatttgccgctcttttgtcgagtcattacggcattgaagtcactccggcgttattttacagctatgccacgctcggagacgtcatcagctattacctgacagaacataaagaaacgatcgaaacgttttaccgaacggaagaaaccgaaacagaagccgccgctccggataacaaggagtatacggatcaggagatcatcgccatgatgaaacaggtctctgaggggacattagattttaaaagagtgcaagacatcatagaagggagtaagacctatgaatcataaagaacttctcgatgcctacagatcaggaacgctcaccatcgctgaagtagaacaaaagcttcaggctttcaagcggacaactgcaaaacgtccgctttctgaaggccagaaaggtttgtggatgcttcagaaaatgtttccggagatgagcgcatataacattccgttatgctttcgttttcaaaagctggatgtcgagacattcaaaaacgcccttttgtccgtgcagcgccagcaccctattttgaccagtgtgataaaagaggaaaacggccttccgtatcagatagaagatacggatcggcattttccgattgaagaaatggatctttccgaattaagcgggcgtgatgcgcttacgtttattaaagaaaaagcaaaagaaccgttctcgcttgaaaccgggccgctcctgcgtgttcaagtattccggcgggcgaagcgggagccgattgtgttaattaccattcaccatatcatttttgacggcgtctctcttatgacgtttatgtcggcgctgctggacgcttatgtaaaagcaagtgaaggcaaagaacctgtcatgcttcagcaggccgcagattatcatgactttgtgaaatgggaaaaagagctgctggaaagcgaagcgggaaaaacgcatctgtcttattggaaaaagcagctgaaaggaccgctgccggtgcttgagcttccgtcggattatccgagatcatcggttcaaacttgcagggggcaggcgtatcagcgcttgcttcctgatgaactgaaccggcagattaaagtttgtgcccaaaaaaataatgtcaatgaatccgttgtgtatctcgctatttttaaaggactgctctatcaatatacgaatcaggaagatgtcatcgtcggcatgccgacgatggggcgttctgaggctcaatttgagtctgtcatcggatactttattaatatgatcgcggtcagaagcagggagacgggcgccaaatcttttacgtcgtttttgaaggagctgcagctgacactggcagaagggctggaccatgccgcgtatccgtttcccgcgcttgtaaaagaattgaagacggaacgctcgcctgcggtgtcgcctgtttttcaaaccgcgtttttctatcaaaacttcttccggacagaaggagcggaaaagctggcggaactatatcaatcactcggcattgaaatgatagaagacattcatcaggaaggcgaatttgagcttgcgcttgaagtctataaaaaagaaacgggaaccgtcctgcaatttctgtacaacccggatgtctacagcccttctttcatcgaacgaatggcggagcattatatgaaactggcagaaaaggtgctttctgatccggagatcgcttttgaagcatgttccggcctgcttaatcaaaaacgtgaagcaagccgttcatcccatcagccgaatgagcgctgcattcatgaagtgtttgcggaaaaagccggacgccaccctgacagagaagccgtcacattcggtgaaaacagtcttacatatcgcgaattagatgaacgaagcacggcgctcgctgtgtacctgcaagaaaagggcgtcacaccggaatgcccggtcggcatttgtacggagcgttcttttgagatggtcatcggcatcctcgccattttaaaagcgggaggcgcgtatgtgccgctggacccggcttttccaaacgaacggatggcgcacgtgttgactgacagcggcgtttcaatcgtattaacgcaggaaaagacgcgcggcatgattgaacagttggccatcggcggtgtgagcacggtggaaattgaaaaccgcggacgttctgtcagaggggcacaactgacgccgcgttcaaaaccgcatcatctcgcttatattctatatacatccggaagcacgggaaaaccgaaaggcgtcatggttgagcacagagccatcatgaatacgctgcagtttttagaagctgagtacccggtcgctcaagaggatgcctatttgttaaaaacgaattacgtatttgacgtttcgatttctgaattattcggctggtttatcggaaacggacggcttgtcattttgccgcctggtgcagaaaaaaatccgcagctttgcatggaatacatccaaacccaccaggtcacgcatctgaattttgcgcccgccgtgtttaatgtatttctggaaacggtaaagcggcatacggcatttacagaagacggccctgtgaagtatgtgatggtggcaggtgaggcgtttccgaaagatttagtcaaaaagtcagtttccatcttcaaacatgccagaattgaaaatatatacggcccgacggaaacatccatttatgccgcttactacagctgcggccaaaaggaaatcacaagcaggaatacgccgatcgggaaaccgattcacaacacgcggctttatatcgtcgatgaaaagctcagccccgttcctgacggtgtggccggggagctttgcgtggccggcgccggtctggccagaggctattacaatcagcctgagctgacggcggcatcatttattgataatccgtttagtgaaggagaaaaactttacaagacaggtgatttggccagatggctgcctgacggaaatatagaatatgccggccggattgacagtcaggtgaaaatccgcggcttccgcatcgaattgggagcgattgaaacgaaattgagcgaacatccggatatccttgatcaggcggtagttgttcaggaaaagaacggacataaaaagctgattgcttattatacggcccgctccggtcatacggcagatgaaaaagcgctccgcaaccatcttttatcgagtctgccggattatatggcgcctgcccattttatccgtctggatgcgctgccgttaacaccgagcggaaaagtgaaccgcaaagacctaaaacagcgcaaggtaatcgttcaccggtctgaaaagacgggcagactgccgttatcagaagcggaagcgaaagtgaccgcaatatgggaagacctgctgaatacggcgggcatcaaaaccgaagacggctttttcgatgtgggaggcgactcgcttctggctgttgcagcggcagaacgcattaaacaggagctggaatgcgattttaccgtcacggatttattcgaacactctaccattcaggcgatcagccgatttattgttgaaacaaaacaggcagctgaatcagaggtgcccggccaagatgaaagagaaaaagaacatacaccgcaaaacgggatgccgtcttactttgaagacagtgtggcgatagtggggatttcctgccagttccccggcgcgaaaaatcatcatgagttttggaagcagttaagagaaggaaaagaaagcgtccgtttctactcggaagaagaacttcgggaagccggtgtgcctgaggatttgatcgaaaatcccgactatgtgccggcattatcgacgatagaaggaaaagatctctttgaccctgagttctttcacatttctccgaaagacgcagaatttatggatcctcagctgcggcttctgctgcttcattcttggaaagccgtcgaggacgcgggatatgtatcgaaagagattccgaagacaagcgtatatatgtcggcaagcaataattcgtatcggtcgcttttgccggaaaaaacgacagaaggccatgaatctcccgacggctatgtgtcatgggtgttagcgcagagcggcacgattccgacgatggtttcccataagctcggattaaaagggccaagctatttcgttcattccaattgctcatcatcattagtcggtctttattcagcctacaaaagcataacgagcggagaatcggaatacgcgctcgtcggcggagcaactctgcatgcagcggccggcatcggctatgtgcaccaaaacggattgaatttttcaagcgacgggcatgtcaaggcatttgacgcttcagccgacggtatggcgggcggagaaggagcggccgtcattctgctgaaaaaggcgtcacaagccgttcaggacggagatcacatatacgccatgctcagaggcatcggtctgaacaatgacggagcggataaagtcggtttttacgcaccgagtgtaaaaggccagactgacgtcatccagcatgttttagacagcacgaatattcacccggagacgatttcctatatcgaagcgcacggcacaggaacgacattgggtgatccgattgagatgtccgcgctgcagcaagtgtataaacgttacacggaccgggagcagtattgcgggatcggctccgtaaaaacgaatatcggacatttggatacagcagcaggtctggccgggtgcatcaaagtcgccatgagtttatatcaccgggagttggcgcctaccattaattacacgtcaccgaatccgaatatcaaattcagcggttcgccgttttatgtggcggataagcgaaaaccgcttccggagagagagacgccgcaccgcgcagcgttaagctcattcggactcggaggaacaaacgcacacgccatttttgaacagtacgaaaacaaagcgatcagcggatcaaaggacggacagccgccttttatcgttccgctgtcagcgagaaataagcagcgtcttactgcctatgcatcttgtttatccggctttctggatgaagccgaaaacgatgtttccttgcatgatctggcatttacgtatcagaccggacgtgaagcgatggaagagagagccgtttttatcagtcatgatcgtcacgatttgaagcgtcagctgcaggattttatcaacggcaatgaccaaaacatcttacggggcgaaaaagtgagaagcagagaagtgtcagctcaggagatggaagagcttgcgtcatgtcagacacgggatgaaaagctgaaagcactcgcggcgctctgggttgaaggagcgcgtgtcgattggggcttattgtatcaggattccgcgccgcaaagaatcagtgcgccgacctacccgttcgcagaggagcgcttctggccggaggaaactgtgaagcaaacggataccaaacttttgcatccgttggtacatcagaatacatctgtcttgcaggagcagcggttcagttcggaattcacgggaaaagagtattttattgccgagcatatcattaaaggaatggcgatcgtgccggctgccgttactcttgagatggcacgggccgcggcggagaaaagcatcggcggggcaacagaggaatctctgggcctgcgcttaaagaatattgtttgggtccgcccggtgatagccgatcaggacgctgtccgtgtccatatcggactttatgaagaagaggacggacagattcattacagaatgtacgggggtaacgattctatcggtgaagaagctcctctttataatcagggcatcgctgaaatcatccggaaggaaccggaggaagcggcggatattgagcagctgaagcgccggtgcacacagggaataatcgaatctcaagcgttttacaaaggaatgatcggtgctgattacgggcccggatacaaaggggtgcagcttgtatacaaaggagaagaccggctgcttgctaaattgaagcttcctgaatccgtctctcatacaaaagctgattatatccttcatccgagtataatggacggtgcgcttcaggccgccgaatatttacaaaacgtgacgagagcgctgcttgcagaaagcggggaaccattcaaagccgcattgccgtttgctttagaggagctggacgttctgaagccgtgcgctgatgatatgtgggtgctcgtcacattcagtgcgaacaataaagccggcgatcctatccaaaaagccgatattgatctatatgacaataacggcgggctttgtgtgcggatgagaggtttctcaacgcggatcatggaagaaaacgcgggtgccggcatttcggtcagccgtacggacacattgctcgctgaaccggtctggaaagagcagccggaaccggcggaccacgagccttcgtatgaagagcatatcattttcctttgtgagtacgatgaagctgtaaaacaggccgtggaagcaaagcttgaacatgcaagcgtcattatcttggacgatcgtcccgcatctattgcagagcggtatcattcttatgcgggtcagatgtttgaccatatcaaaaccataatgaaaagcaagccgatgggccgcgttcttcttcaggctgttacgcggtcagcaggcttacagcaggtgttctcaggcattaccggactcttcaaaaccgcatgccttgaacattccaagctgatctgtcaaatgatcgaagccgaggaggaagaaagtgctgaaggcatagcggaaaaagcgtccgaaaaccgtatgcatgccgaaagcgtccatgtgaaatatgaaaacggcaagcgctttgccgctgattggggagaaatggatatacctcaagcggagccggacattccgtggaaagacgaaggcgtttatctcattacaggaggtgcgggaggtttaggtctgatttttgcaaaagagatcgcaaaccgtacaaaagacaccgtcatcatactaaccggccggtccgctctcagagaaaagcagaaagacatgctggaaacagtacgtgctgccggcgcttctgttttctacgagcagaccgatgtcacggacgaagcagaagtataccgattgatccgcaatatccgcaaacggcacggcaggctggacgggattgttcacagtgccggcattataaaagacaactacatggtgaagaagacggcagaggaataccaacacgttctcgctccgaaagtgaagggccttgtgtatcttgatgaagcgtcacaacatgagaaattagatgtctttattgtcttctcatccttatcaggtgtgcttggaagcgtcggccaggctgattatgcgtctgcaaatgtctttatggagatgtatgccgagtaccgccgttctttacaagccgcaggacaaagatacggaaagacgctttctgtcagctggccgttatggaaagaaggcggaatgcaggcaggaaagcagacggaagatatgctgatgcaggaggcgggaatcgcaccgctcggcacagatgccggcatcaaggctttatatcaaggcttgatgagcgggacagcccggatgacggttgttgaaggagatgtgaaacacatgaaagcaaaactgttccgcaaagagaatgatcatccggaagcagagaccggcgtacgtcatgacattgatgctgacagcctgcttgaaaaagtgaagcatctgttaaaacagcagacggcctcactgttaaaagtaaacattgacaaaattgatcctcatgaagaaatgacaaaatacgggctggattctatctcgatgactgagtttacgaaccagttaaacaaaacgtaccggcttacattaacgccgacgattttctttgatcatccgacaatccatgaatttgccgttcatttaatcagtgaatacgaagaggaatttgccggacggtttgcggtaaatacaaaaacggttcaatcggcaagaccggtaaaagagactcaaatcacgcgcccggccgttaagcgacgccgcactctgcctgagacacttccgcagacagtgcagcgggaccaagggccggaaccgatcgcaatcgtaggcatcagcgggattttcccgatggcagaagacattgaagcttactggcagaacctgaaagaaggcaaagactgcatgaccgagattccgaaagaccgctgggactggcgggactattacggggatcccgcaaaagaagccaataaaacaaacgtcaaccaaggcgggtttattgacggaattgctgaatttgatccattgtttttcgggatttcaccgcgggaagcggagcaaatggaccctcagcagcgactcttgctgacgcacgcgtggaaagcgattgaagatgccggatatgcgtcaaagagtctctcaggcacaaaaacaggtgtgtttatcgggaccggaaataccggctacggttctcttttagccaatgccgatgcggagattgaagggtcatccgcggcgaatacaagtccgtctgtcggaccgaaccgtgtcagctatacgctcaatctgcacgggccgagcgaaccgattgataccgcctgctcaagctcgctcgttgccatacaccatgccgtttcttcaattgaagaagggacgtgcgacatggctttggcgggaggaatcaatacgattgttcttccggatgtgtatatcagttttgataaagcgggcgcgctgagtaaagaaggaagatgcaaaacgttctctgatcaggctgacggttttgcccatggtgaaggagccggtctctttttcctcaaaaagctgaaagccgctgaggcggatggggaccacatttacggcgtcattaaaggaagcgcggtgaatcacggcggccgcgcggcatctttaacaacgcctaacccgaaacaacaggcggaagtcattaaagccgcatacaaaaaagcgggcattgatccgaaaacagtctcttatatcgaagcgcacggcaccggaacagaactgggagatcccgttgaaattaacggcctgaaacaagcgttcagctcgtttacagacggaaaagagaaagcggccggctattgcggcttagggtcggtcaaaacgaatatcggccatttatcccttgccgcgggggcagcgggcattattaaaattttgctgcagatgaagcatcggacactagtaaaaagtctccactgtgagacggtaaatccgtacattcagcttgaagacagcccgttttatctggtgcgggagacgatggaatggaagacgcagacggacgaacgcggtaacgaacagccgcgccgcgcgggcatcagctcattcggcatcggaggcgtaaatgcccacgtcgtcatcgaagaatacatcccagaagacagagaggaagcagatgattctcatatcgatccatgtcttttcgttctgtccgccaaaaatgaaaaacgcctgaaagagcaggcaaaacagctgaaacgtgcgcttactgaaaaacggtacgatcaatcctccctcgtttctatggcatataccctccaaatcggaagggacgccatggaagaacgcctggcggttattgccggatccgcagaagaactgcaggaaaaactgtcacagtttatcactggagataagcacgcggacttgtacagaggaagaatagacaaaggcacgctgcaaatgctgacggaagatgaagaaattcaagaagccgttgaaaaatggatggcccgcggcaaatacgcgaagctgcttgaattgtgggtcaaagggctgaacgtcgattgggcgaagctgtatggagaccggccgcctaaacgtatgagcctgccgtcgtatccttttgcaaaagaccgttattgggcggcgaaacataccggaaaacacgaaaaaacaaaaactgtatctgccggaaaacaagacgcgcttcatccgcttctgcacagaaatacttcaaaccttgcagaacagcggttcagttcaatctatacaggagaagaattttaccttgcggaccatgttgtaaaaggcgtgccgattttaccgggagtggcacatcttgaaatggcgcgcgcagcaatggaacaggcatctgaagttccggccggacaaggaagcgtcaagcttaagaatacggtttgggtgcggccgatcaccattgaagacgagccggttcatgtcaacatccgtctcattcctgaaacggcaaatgacgttcaattcgacatttacagcggccgggacacagatcagccgtccgtttacagccaaggggcagtatcagtccgccctgacgccgaggctccggtcattgatctccaaaagctgagatcacaatccgccgagacaccgttttctgcagatgaagtgtacgatatgtaccgcaaaatcggttttgattacggcccggctttccggggtgtcaaagcgatttatacaggtgatgatttcgtattgggcagactgtcacttgatgcggcttgtgcggacacggtacaggagtatgtcatgcatccgggcttaatggactctgcattgcaggcatcaagcatattaaccggaacaaatgatgaaaaactgatgcttccgtttgcggttcaggagcttgaagtattcagcgcatgcgctgccgagatgtgggtttacgccagactttctgaagaccacaaagccggccagattgaaaaacgcgatcttgatatttgtgatgaaaacggcaaggtttgcgtaaggctgaaaggtttgtcattcagaatggctgaaaaagaacctgagaaaaaagaaaaagctccgggaacgctcatgcttgagccggtatggacccgaagtgatgaaaccgccgttcaaacggaaccggtttttgcccggcatatcgtgttgctttgtgacacagaggccggattgaaacaagccgttgaagccgcgggagctgcatgtattgaaatgacctcccagcacgggaaagcggcggcgcgcttccgtgattatacaggacggatattggagacgctgcaaaaactgctgaaggaagagacggatggagacgtcttcatccagacggttctctctaaaacagataagcatcagctgctctcaggcatttcagctttgttaaaaacagccggcctggaacataaaaaactgaaaacccagctgattgaaatagaaccggcggaaaacggcagaatcacagacatcatcagagaaaataaaacacgggctgatgacagccatatcaaatatgaaaacggcatccgatacagcgcagatgtcaaagaaacggccgtgtccggcggcaaaatacgcattccgtggaacgacggaggcatttatctcattaccggaggagccgggggcttaggctttattttcgcgaaagaaatcgcccgcaaagtcaaagagccgatactggttttgacaggccgttccgcattaagcgagaatcagcggatgcagctgcaatcgcttgaatcactcggagcaaaagcggaatacaggcaggctgacgtaacaaacgctcaaactgcggcagacctggtcaaaacaattgagacggaatatggcggccttcacggcatcattcatagcgcgggtgtgatgaaagatcaatatatcgcaaagaaaacaaccgaagagttttacagtgtattggctcctaaaacggacggatttgtcaaccttgatgaagcaaccgagcatttagcgctggactttttcatcgttttctcatccatttccggcgtcaccgggaatgcgggacaggcggattatgcggcggcaaacgcatttatggacagctatgcggcataccgcaacgcgctggttaccgcaatgtaccgccacggtcacacattgtcggtcaattggccgctttggaaaaacggcggaatgcaagtcaatgaagaaatggcgaagctcaccgaaaaaagaaccggcgtaacgccgatgcgcactgaggccggaatagaagctctttacaaagcatggagcatggggaaaacaagcgtgctcgtcatggaaggaaaccgcgccgtaatgcgggaaaagctgcttcaaaagactcctgacgccgcttttgcaccggttaagaaaacggatgaaacgtctgcgccgaaagacctgacggcaaaacttcaggaattgctggcaaaagaggtttccgggcttctgaaaataaacattgaagaaatcgatatcgaattggagtttaatcaatacggatttgattccattacgctgacggaattcgccaacaagctgaatgacacttatcagcttgatctgacaccgaccgtattttttgaatatgcgacgattcaagccttggcgcatcatttagcagaagactatcaaacacaatttgccggcagcacacagccgaaagaagaaaaacaaagcagcgtaactgatgatggcggtatcagactggcagggaacaaacgatttgcaaaaactgccgtacagcctgttcagacggcggctgaacataaaccggaaccgatcgccattgtcggcatgagcggagtgtttccgaaggccgcaaatattgatgagtattggcgcaacttagaagagggaaaagattgtataacagaggtgccggcggatcgctgggactggcgtgagtattacggtgacccgcttaatgaagccaataaaacaaatgtaaagtggggcggatttattgacggagttgcggattttgatccgctgttcttcggaatttcaccgctggaagccgaacagatggatccccagcagcgcttgttaatgatgtatgcgtggaaggcgatagaagatgcgggatattccgctaaaagcctttccggcacgaaaacaggcctgtatatcggcacggggaataccggatacggctcactgttttccgacctggatatcggcggtgcgtcagccgcaaatatgagtccgtcagcgggaccgaaccgcgtcagctatatgcttaatctgcacgggccgagtgaaccgatcgacacggcttgttccagctcgctggtcgcgattcatcacgccgtatgcgccattgaaaacgggaactgcgatatggcgatcgccggcggcgtgaatactgtcgtcacaccgcaaggccacatcgcttatgacaaagccggcgctctgagcaaagaagggaaatgtaaaacgttctccgacagggcggacggatttgccgtcagtgaaggtgccggaattctgtttttgaaaaagctgtcagaagcggaaaaagcgggagatcatatctacggtgtcattaaaggcagcgcggtcaaccacggcggacgcgcgaactccttgacgacaccgaacccgaaagcccaggcggaagtcgtcagaacggcttatgacaaagcaggcattgatccgagaacagtcacttatatagaagcgcacggaaccggaacggagcttggcgatccggtcgaaatcaacggcctgaaatccgcctttcaaaagctgtacgaaaaaacaggcgattccgccgtttacgcgagtcactgcggtctgggttcggccaaaaccaatatcggccacctgtcactggcagccggtgtcgcgggtgtgatcaaagtgctgatgcagatgaagcataaaacacttgcaaaaagcctccacagcgaggtcatcaacccgtatatcaagctgaaagacagtccgttttacatcgtacaggaaaaaagagaatggacggcattgaaagacgaaaacggcaatcttctgccgcgccgtgcgggaatcagttctttcggcatcggcggcgtaaacgcccatgtcgtcattgaagaatatatcccgaaggaagaaagaaaaacagctgttttcacacaccctcaaatctttgtgctgtcggccaaagaagaagaacgtctgcaggaacaggcgcagcagctggcgcaagcttcttttacggatgcggatcttgccgatgttgcttacacgcttcagcaggggcgtgatgccatggaagaaagagcggccattatcgcttcctcggccgaagaactgcgggacaagctaaagagctgtgcgaaaggacgttatgatatagcgggcatttataaaggaaaagcgggtaaaacctccctgaaatccattctggcaggtgcaaacggcgaggcggatatcgaagagctgataagccgccgagagaatgacaagcttgcggaattatgggtgcagggcgcggatatcaaatgggacggcttatattctgatatcaagcctcaacggctgagtcttcctgcttacccgtttgcgaaagagcggtactggatcacggacaaccggccgaaagcagagaaaccgcaagctgtgccgacgtcgcgggtgctgcacccgctgcttcacgaaaatgtatcagatttaacagagcagcggtaccgatccgaatttacgggacaagagacgattttcaccgatcatcttattaagggcaagccggttatgccgggcgttgcctacttggaaatggctagggcggcggttgctcaggcagtcaaaggtcaaaaggaacgtccttctgtcacccgcctgaaaaacatcgtttgggttcggccgatcgaagcgggaaaccgcccgattgaagcgcagatcagcctgaacccgagggaaaacggtgaaatcgtgtatgacgtttacacggattcacaaacagaagcaagcggcaggcagatacactgtcagggggctgccggcattctcagcgccggggaggctccgcaccgtgatataggcgcactgaaagctcaatgcggcctcagtatactgacttctgaacagtgttacggcttattcagcaaaatcggcattgactacggtcccggacaacaaggaattcagcagattcatatcggaagcaatcaagcattggctgagctccggctgccttccttcctcgaagaaacggcagatcaatacgttcttcacccgtgtatgcttgattcagctttacaagcgacaatcggtctgaagctgcacgcagatgataaccagctgtcactgccgttcgcccttgaagaactggacattttcagcccgtgcacgacaagcatgtgggcgtatgtcagctcccggggaacggatgaaaaaatacagcgtatggacattgacttatgcgatgagacaggccgggtctgtgtcagaattaaagggatttcttccagaatgatggaaggccccgcgccggaaacatcattaaatggagcaaaccttctggctccggtgtgggatctcgcggaattccgtgatcaaagcccggcatataagacggaagaggttgtctttatcgcgggggatgaggaaagcgcggtttttcaattgcatcatccttctgcgaaacggcttaatatcaacccggaggatgaaatagaggctgttgcggctgaactgaaagcaacagggtctttcgggcatatcgtatggatcgctccttttcacagcgctgacgacatggtaaaagctcaggatgcgggcgtcatccagatgtacagagtgattaaggcaatgcttgctttaggatacggaggcaagcgaatcagcttgactgcagtcacaataaaaacacagtccgtacagccggcggacattattgatccggctcatgcaggcattcacggtttggtcggctcgctcgcaaaagagtatccgaactggcaaacaaggctgattgatgccggatgtccggaagatgtttcaaaggcggagctgttctcagcgccgtttgatgagcaaggcaatacatgggcgtaccggaacaatcactggtacaaacagcgccttattcctgtacagcagccggtgtcaagccggcccgcttaccaacaaggcggcgtttatgtcgtcatcggcggcgcggggggcatcggcgaggcatggagcgaatatgccgtgaaaacatatcaggcgcgagtcgtttggatcggcagacgaaaacataacagcgccatccaggaaaaaatcgacagactcagccaattcggcccggcgccgatttatattgaagctgacgcggcaaatccgaatgagctcacacgggcgtatgaaacgatcaaacgcacgcacccgcaaattaacggaatcatccattccgcaattgttttagaggatcagagcctgaaaaatatgccggaaagccgttttaaaagcgtgctcgctgcaaaagtcaatgtcagcgtgaatatggcccgcgtgttccaaaatgagccgctggactttgctttgttcttctcatctgttcaatcatttgcacgagcggccggacaaagcaattatgctgccgggtgcagtttcaaagatgcctttgccgctcatttggctcaagtccggccgtattcggcggcagtgatgaattggagctactggggcagtgtcggaatcgtatcatctgccgattatcaagaacggatgaaacaggcgggagtcggatcaattgaagcgcccgaagcaatggcggcgcttgaacgattgctcggcggcccattgaatcagttcgtcatgatgaaacaggcggaagagccggaggaaaaaccggaagaaatgatagaagtataccctgaacatcacggctcggcgatgcaaaaactgcgaagctatcagcctaaagtaacaagacatgtacaacaattgagttaaggaggggacggctttgcaaaacactgaagatcttctttacaaactattggcaggccagctgaaatctgtcggattttttacggaaaacgaaacgcagcctgtcatgcaggggttttacggcaggtggctggaagaaagcatctccatcttggtgcaaaaaggctttttgaaacagtctggcagtacgtatgtgttaacgggtccgatagagcgtgcggacgttctgtggcaagaatgggatgaaaagaaagctcctttactcaaggacagcagcaaacgggcgatgatcaccttagtggagaccgctctcagagctttgccggatattttatccggcagagtttctgccactgatgttctgtttcctgattcctcaatggaattggttgaaggaatctataaaaacaatgaaacggcagactactttaatgaggtgctcgctgacacattgacggctttcattgaagaacgcctgaaagaagacccgaacgcggaaatccggatattagagatcggagcggggacgggcgggacgagcgcggccgttttcaaaagattaaaagaggtcaaacctcatgtgaaagaatattgctacaccgatctgtcaaaggcctttttcatgcatgctgaaaaagaatacggtcccgacaatccgtatttgacttataagcggtttaatgtggaagagcccccggctttgcagggtatagaggcgggtgcatatgacgcggtaattgcggcaaatgtgcttcacgcgacaaaaaatattcggcggacacttcgcaatgccaaagcggtgcttaaaaagaatgggattttgctattaaatgagatcagcagccattcggtttattctcatctgacattcggtcttttggaaggctggtggctgtatgaagacgccaaactgcgtattcccggatgccctgggctgtatcctgaagcatggcagtctgcgctggaaagcgagggatatcggtacgttacatttatggcggaatcgtcacatcacctcggccagcagatcgtggcggcagaaagcgacggcgtcatcaggcaaaagcagccggacgcgccggcggttgaagaaattgcggcttccaaagagccggctgatttcacagaaccgtctttctcagtcacagaccggacggtgcaattcataaaagaaacgttagccaagtccataaagcttgctcccgagcgcattcagccggaaaccagctttgaaaaatacggcatcgactccattttgcaggtgaattttatccgtgaactggaaacattgacgggcgagctgccgaaaacggtcttatttgaacacacgaatacgaaagaacttgccgagtatttgctggaaacttacccggataagctgcaacaggcattcggagccgatcaagcgcctcctgaaacggagcatccggaacctgcaatgaatgaaccggtgccgcttgtcacggaaacacggcgatttatcactgaacaaaaagagccaaaagcgctaaagccggaaacagaaaccgtcaccgataatcgctcagatcgtgacgacattgccattatcggcatcagcggccgctatcccgagtctgaaaccctcgatgagctgtgggagcatttaaaagccggagacagctgtattacggaagctccggaaaacagatggaagtccggtcttctgaaaacaatggcaaaagaaacacgaaaagaagaacgcaaaacacggtacggcggatttctgaagcatattgacgcttttgaccatcacttgtttgacatccgggaagaccatgtgatggagatgacgcctgagctccgtctaagccttgaaaccgtatgggaaacatttgaaaacggcggctactcgttagaaagagtaaacgaatggcaggaatcagacagcgggatcggtgtatttatgggcagtatgtacaatcaatatttctggaatatcccgtcattggaaaaagctgcactcagctctaacggaggggattggcatatcgccaaccgcatttcccactttttcaatttaacgggtccgagcatgggcgttacgaccgcatgctccagctcactgagcgccattcatctcgcctgtgaaagcctgaagcttaacagctgttccatggcgattgccggaggggtcaatctcacgcttgaaccgtctaaatatgatgcgctcgaacgggcgaatttgcttgagcagggaagtgaaagcaaaagcttcggaaccggcacgggcctgatgccgggagaaggagtcggagcagtgctcttgaagccgctctccaaagcggttgccgacaaagaccatatttacgggatcattaaaagcagcgcgttgtgccatagcggcggaaggcagatgtacacggctccggatccgaaacagcaggcgaagctcatggcggcttccattgacaaggccggaatcaatccggaaacaatcagttatgttgaatcagcggcaaacggctctgtattgggagatccgattgaggtcattgccctgacaaacgcgttctcgcaatataccgataaaaaacgattttgcgcgcttggatccgtcaagtcaaatctcggccatttagaggcggcctccgggatgtcccagctcgcgaaagtgctgctgcaaatggagcgggaaacattagttccaaccattaatgcaaaaccgcaaaatccgaatatcgtgcttgaacaaacggccttttacctgcaggagaaaaccgagtattgggagcgtctgaaggatgccgagacgggagacatcataccgcggagaagcatgatcaattccttcggggcaggcggggcatatgcaaatctcatcgtagaagaatatatcaatccgaattctaatcatgcccgtcacggcaatgaggaatatattttccctgtgtcagcgaaaacaaaatggagttttgaagcctatcttgagagactggcggcctttttagaaaagacgccatctcttcatccggccgccatcgcatccgcgctgcaaaaaagaacgcatcatccggagtatcgggcggcatttacggctgcttccgttcaggaactgtcggaaaaactggccgcttaccgcatggatcagcggaatctcaatttctccgattctgatatcggccggcgtgcgcggcaatgggaaaaaggagagaatatcacgtttgatcagttgcagcaagagcacgccgttcatctgccggcctacgcttttgaccacgggacttcttttcatttcggtgaatcagaaaacgctgccggcgttcaggcggtatacagtgatgacgacccatacgtgaaagggcatcaattcagcggagaaccggtactcgtcggcgctacatataacagtctggcagtcgatcatttttgtgatctttttcctgaagcagagggaggacatattaaaaaactgaattacgtcagccccattaccgtaaaaaaaggcgatcgcatcgagctgaaaacagaatcgaaacaaaacggggatggatttgaactgagcataatgcaccgcagccgcacgtctcctgattggagcatagcggcgtatgccgagtgcagcccgtatccgtttcaaaagcagcacgcggatctggcggccattcagcgctcataccgggaagtgggccggatagatgagttatacggagacggaacgggaaccgtcgtgtggggagaagaatttaaaacgatcacccgcctgtacaaaggcactgatgccgttttagcgaaagtgaacctgaacaatagcgactcacaacaagcgcatcattatgccataaatccgttaatcgccaacagtgcttacttggcctcgctttctttattggaccaaacagaggcggaaagctatctgccgttcggcattaattccgtcaccttcagcagcccggaaaatcttaccgattgctggctgcacatcaagctggccaaacaaacgggggaaatgattctgattaacgcagatgtcatcagcagccgatcggaagtggtgatgcgttttgaaggctatgccctgaaacggttccgcccgaaaaccgaacagatgaatcagccggcccgaacggctgtgaagaatgcgggagcaccgatttctgccggcagtctgacagatgatatccgcagctacgtccttggcaagctcgctaagatgatggatgaacccgcgccatctcttcgttctgacgcgaatatcatggaattgggacttgattcagcgagcctgatcgggctgacaaaagagatcggccaagaggcggacatcgatgtgaatccaacattgtttttcgagtatccgaccgcggaggagctgacccgccacttcgcgtcagcatatgagagcaagttttctcaattgcttgccgatcataagcattcagaagaggccagggtcacggaaacagaagagcgcactttaccgaagaaacagcatacgccttgtgataacgccgatatcaagcaaggaatcgcgattatcggtatgtcagctcagtttccgcaatccccggatatccagtctttttgggagcacatcgtaaacggggatcactgtattaccgaaattccggcggaccgctgggactggcgccgttacgccggtgatgagaatgacacgagtctcagatggggcggttttattgacggtgtcggcgaatttgacccgctctttttcggaatttcccctaaagaggcatcacaaatggggccggagcaatttctgcttttgatgcatacatggaaggcaatggaggatgcgggcctgacaaataaggcgttatcaagcagaccgacaggcgttttcgttgccgcgggcaacagcgatccgaacaatggaacagccatcccgtccatcattccgaacagaatatcatatgccttgaatttacaaggaccgagtgaatattacgaggctgcctgcacgtcaacgctggtggcattgcacagggcggttcaatcaatccgtcataacgaatgtgagcaggctgtcgtgggggccgccaatattctgcaatcgccgaagggctttatcggttttgactcaatgggatatttaagcaaaaacggccgggcgaaatcgttccaaaaagatgccgatggctttgtcagaagcgaaggggcgggcgtgatcatcatcaaaccgcttgaggcggcaattgaagacggcgatcatattcacatggtcattaaaggaacaggagtgtctcacggcggtaaaggcatgtcgcttcacgcaccgaatccggcgggaatgaaggccgcgatgaaaaaagcgtacgaagacaccgatgttgatccgcaaaccgtcacttatattgaagcgcacggcattgcctccgaaatggcagatgcgctggagtttaatgcaatcaaagcgggttacggcgagtctgcaaatcaaggggaaagcgcgccttgttatatcagcaccgtgaaaccttgcatcgggcacggcgaactcgcttccggactggccgcccttataaaagcggcgatggccatgaagcatcataccatcccgggcattcccggatttacagctgcaaatgagcaaatggccattcagaaaagccgcttccgtttcaccgaagacaatcaggaatggacacagctcaccgaccatatgggcagaccgattccgcgccgggccgcaattaacagctatggcttcggcggcatgaatgcgcatgtcgtcttggaacagtacagcccgagccataaagacaaagaatctgcgtgtgaaccgcagcttatcgtgctttctgctaagagcgaaggacgtcttaaggcggccgcaggtcagctggctgattttgtgcaaactggagatactccgtcattgcgggatattgcttatacgcttcagaccggccgtgaggcgatgaactgccgcctggcactcgttgcccgcaatcaagatgaattgctggaaaaactgaaagagtacagagcattttccgaagaaagcaatggaatgaaaagcttctttacaggcagtcagcagactggatcaggagatatcggcgttttactggaagggactctcggtacagtcgtcacggagacgctgttggctgaaaacaatctggaaaaacttgcattttgctgggtgaaaggtgcggatataccgtgggacagactccaccaaggcaaatctgttcaaagagtgccgcttccgacatatccttttgaaaaccataagtattggaacggcggtcagtcagaagacatcagccttgcaccggtatcacagaatcctcagatccgctgcgagagcgcggctgacattgtggcagacattttggggatggagccagcggaaatggatcaaaataagccgctgactgaatacggcttcgattcaatctcctctattcagctgttgaagaaacttgaggacggagacagccgcatcagtctggaggctcttcagaaatgcagcactgttcaggagattagcatgctgttaaaaacgaaccaatcgcaggaggcgggccgaaattttccagaactcgtcaagctgaatgatagagaaaaaggccgtcctgttttttggtttcacggcggaacgggaggcgttgaagcataccagccattcgccaaaaagagtcagcgacctttttacggcatacaggcaagaggtttgacagggaaagagccgctgcaaggaatcgaagagacggccgcttcttatatgagaatcatccaagcggtacagccgaaagggccttatgacctcggcggatattccttgggcggaatgcttgcatatgaaaccgcgcgcctcttgcaggaggaaggtcatacggtaaaaagcgccgtcatgatcgacaccccgtacagtgaaaaatggaaagaaagaaaaccatctgttaagtcggtcatgctgcaaacgatcaatacgatgcttacagcatatcttaagcctgaaaaccttgaagaggcattaatcagcagagaagacattaccgtccaggctgaggaagaagaagtattgaaagaattgaccggccttgccaaaaagcgcggtctgccaaaatccgaagaagcgatccggatgcagctggagcaaatgatgaagacgcagctcgcttacggaatggaagagtatgacatgaagccgctgcctcatccggaagcgctgcaatgctactacttccgtaataaaagcggtttgttcctcggagatcttgaacgttatctgacagcagaggaagaacaaatcccgttagaccatgatgcgtattggaaagaatgggaacgccagatgaaacagtttcacctgctggacgttcactcttccaatcatgtcacaatgctgtcggaaccaaagccgcaaaacgccattaaggcattctgcgaaaaactgtacgcaaacaaaggaacgatcagcgcaaatttccttaaatctttcagaaaaaagctggacgaaacaaatgagctggtaaaacggtaatagagaacggccggagcaatccggccgcttttttatctatatagaactaaattcactatgtactaaatattcactaatgtattgatttccgtttataagacattaaaaaaacccccaataacagggggcgatattaaaatctgacaggcaatgtttcaagccctctcaaaaacacattttttctccatgttacattctcgggcgcgcctttcagctctatattcggaaaccgttttaaaagcgcggtaaaggcaatggatgcttccatccgggcgagcggagccccgagacaaaaatgaatgccgaatccaaaagagatatgacggttcggtgttctcgctatatttaatgtatcaggatcatcgaaatattccgggtcccgattggctgaaccgatgccgataaatatcatatcaccttttttaatagaaacatctttataggtgaaatcttcaatcgcccatcgatttgccatcatgatgacgggagaggtataacgcaaaagctcttcgaccgccgtctggatatcttcgggctgccgctttatcttctccatctggtctttgtgcagaagaagcgccagggtgccggagccgagaaggttaaccgttgtttcaagcccggcaacgactaacaaaaacagcatggaatacagctctgattcactcagcttttggccgtcctcttcagcgtaaataagcttgcttgtcagatcttcagccggatgttttcttttttcttcgatcagtgttttcatatattgtttaaattctttgagagcctggttggtcgcatcttgtccgctttctgacgtgtcgaccattgcgtttgtccacacttgaaatttggcgcggtcctctttcggaattccgagcagttcggaaatgacgataaacggaagcggtgcggcgaaatctctcatgatatcagggtctgcttttgtttccatttcatccagcagctcttctgtgatctgctctatcccggtgcgaagctgctcaatcatccggggagtgaacccctgatgcaccaaagatcgaagacgtgaatgatccggagggtcttttgccagcatatgctctgagacaaaatcgatatcttcactgacattcagcttcgcgatcagctccttcggcatgacccgttttacatctctcgtaattctgccgtcttttaaaaacgccatacaatcatcataacgcgtgatgagccaagccggaaaggtgcctccgaaacgctgcagttcgaatttatgtatggggtcctgctctctgaatctgcttaaaaccgcaaaagggttttcgtgaaactcgggtgagtgtgggtgaaacattgttttttccatctggatttccccgccttcatgtttttgaaaagacataacaaacagccggtgcctgccgaccggacggcattcctccttttatctgccgaagacactgatcacaacggctcataagtatgtctaaaatatataaggaaacagaagccggttcaatagacaaatcgcaaagccgccattttcgttgattatcaacaaaacagcaaactttttttgccatttcatcatgtgtgttaaatccggctaatatacatatttacgcttcatatcaacttcttaaggaggatgtgaatgaatgcgtttatgaaatgggcggcaagtctgcttttggtgatctctcttcagttcggccttacgggcgccggcatccattcggacagtgctgctcgtgccgcatcccgatacgatcaggtgctgtatttcccgctgtcaaaatatccggagacgggaaatcatataaaagacgccatttcggcaggtcattctgagatttgtacaattgatcggggcggagcggagaatagaaggaaagaatcattgaaaggaattccgacaaagcccgggtttgaccgtgatgaatggcccatggcagtctgcacagaaggcggggcgggggctgatatcagatatgtaaccccgtcggataaccgcggggccggttcatgggttggaaatcaaatgagcggatactccgacggcacgagagtactatttatcgttcagtagcttctccggttcgccggagtttttttatgctctgaaaaagcggcacgccggctggacatatgaaatggcaaagagtaaacttatatgttggaatcagcatgagaaaggattggatcacattgacagtgactacataccgaaatattgcacttttacttctttgtttaacagcgggaattgtggatgtgatcggttatttaagcctgggacatatctttaccgccaatatgacggggaacatcgttctgttcggcctggcgatcggcaactcatggcaccttgccgtactcaaatcgttaacctcgttaatcggatttattgccggcgttattgccgcggccctgcttgtgggcaataaaaagaaatcattctggccccctgcggtaactgcagctttagctattgaaggagctgttttgctgctgtttgctttgttctcttgcttttttgcagacgccatttctgtttatgtgctgattatgctgctcagcttcgcaatgggaatgcagacgacagccgcgagaaaacttggtgtagcggggatttccacgaccgtattaacgggaacgctcgctaatttttttgaagatctcaccgcaaggttttacaaagcggacaagcggaagcagtttacgagagatgctgttttgcgcgcgcttgccttggttctgtattgctttggggcggtcatcggcgcttttgccgaaccggattataagtttgccgtgatctggcttccgattatcattattttaggcattatgctttgcgcattcacgatgttccacggatattctgaagaaaaaaaccaataaaaaaacgccgctggttcagggcgttttttctttttattgctctttccgggtcccgattgtatacacggcccgatctgtatgtacctttaatccgtcttgctccttttggatggtaatatcgccgagcagagggatttcatacgcatcttgaggaagcgggacatttccttcctccgtataggttgtgccgtgcccttttaagacgagctcttcgtccgctacatagtcatcgggatggtttgtccggcggacgagaacatcatcaaggtgaagcatgatctggtccatatcagaaatctcgtttcggctgtctgtcagctctccttttctgatatcaagcgtttgtccgatctgtttttgcagccattcagacaattcggtgtttgtaagtgccattgtgattcctccttttatctacaccatacttattccctatttttatagaaatacactgccttgattgatctttttttctgacagccggttctgaagcattccgagttccttcattataaatgtttcatctgttcacctgaaaaacggagtcatctgcaggtttagacgaccccgttctcatgataaaaaggttactctttcggcacggcgttttcagcgtttactgcgcccgctccgtaaatgttcggatcttcatttgtccattgatccggactttgtttgatcagtgttttcacttcgtcaggcgaaagctgcgggttctgctgaaggattaaggcggcaatgccagcacaaatcggagtggccatggacgtgcccgacagactgaaatacaaggagcctacacggtttgatttctgtaatttgtcaagatatgaacgcggagaacggagagatacgatatcgaccccgggcgcaagaatgtcaggcttctcttttccgtacaccgtcgggccgcggcttgagaatgaagcgaccgtatcgtcctcattgccggccgtattattgtcatcataggcgcctaccgtgatgaccttctcgctgacaccggggcttgaaatcgtttgagcttccggaccggagttgcccgcggcgacgcagacgacgattccttcattccatgcctcttcaacggccttgacgagcggatcgtccgtttctttatcatatctgagcgcatctccgcccagtgacatgctgatgattctgatcggattctttgtgtgttctttattatattgtatgcaccattccacaccttcaatgatatcagccaaggttcctgatcctgatttgtttaaaactttgactccgatcagatcggcttccggcgccggcccctgatatttactggaagatgaagcgccgctgcttgcaatatcaccggcgcaatgggtgccgtgcccgttgtcgtcatacggttctgtcttttggttgacgaagtccgcaaatccgataactctgccttctaaatcgggatgctgatagattccggtatcaataacggcgacggttacgccttttcctgttaatacggtgccgttacgggtcacttcttttgcatgagacgattcagctgccgtatcaaggagcgcttttacttcacggtttaaatagattttacggatatcccggcattgcgaaagaagcatgtgaagggcggacggagtgacttcggcgctgcagcaattgattgtttgaaactgcttttttatggtgcagcgtttttcttttgataagacctgtcctgtgctgtgaaaaccggattcatgacagccctcttcaaattcaatgatgactgacattttctttctgttttttacctttttttcgaaaaacttgtgcaaaaagcaaggtgtccatttgaaaggtttatataactgtaatacgttttctctgagcggccagtccagcttatgagcatttgaccgcaccatttgtaccattgagtaaccaaacatatatacttttcctcccattctggcgattctctctataccatatgaacaggcagtatgttcggtcagtttgtttgtccttcaggagagctggttacttgcggctttttcaggagaagaaatcgagttgaaacggaacgtttgtttggttataatgaagccggcggaaggaggtatatacatgaacataatattgagacattccttggaaaaacagcttccgattgatattatatatatgaaaaaagacggctccatttcaaaacggaccattatgataaaaaaaggggatgagcgggctgtaacggcattttgctgtacaaaaaggcagatgagaacttttttgacgggctccattctgtcctgcgcatttgcttcgggaggcggatattcatttttaaaagcgtattcttgatgccgtccgtttccggccgtgaatctcccgcccctgaaaattcgggcgttcctccctttttttttgccctctctcaaccttttttcactgatgcccggcatttgagcgcttgaaccgtgacaatccattgatttttcgaaaccgggaagtttttcactgatgataatgttaatagaatgttaagataagacctattgacaaaaatccatataatgaacatgtcatttttcagaaaggagcaaagaaggagagctgatgaaaagaattttacttaatgtcatcattatcgtagcaatggtcttactaataagatgtgctcattatgcgtcagaccctgatccctcgaattcttctgatacatacacagattttaaagatctggctgaacatgaagaccccgatgattatcatatatcgtacaataagcgaaaggggagccccgtattgatcatgtcgccgcacggagggagaattgagggcggggtgagcgagatcgtccgctctttcagggatgattattcaacctacctgtttgagggattaaaagcgcatgataaccagactcttcatattacgagcaccaagttcgatgagccttcagcagtcgaaagcattaagcagcaccattatgttatcgcagttcacggttataaaggcgacgagaaaaatactcttgtcggaggaagcgaccggaagcgggcgaaaaaattggtgagagctctcgaacgaaacggattttctgcagaattggcaacctcaaaaaccggtctggccggggttgacaccgaaaatatcaataaccaggcgcaaaccgggctgagcatacagcttgagatcagcagaaaacagcgggaagcgttttttgataattttgattaccgcgaaagggaattcacaaaaacggaggaattttaccggtttgtccgtacgataaaaagagtgatcaatcaagagtattcgtgagcttaaaaaaagacaaaccagtgaaagatgagtaaactgaaaaaaaggaggtttgtcccttggcaaaacatcacttttatttaaaagcaaattggcccggaaatcgcaacgacgtcggcgatattaaaagcggccggctggagacggctgtgtccattcctaaggaaatggacggacccggagaaggcacaaatcctgatgaaatgctgcttggagcggccgcgacctgttatattataacgcttgcggcgatgatggaaagaagcggcctggataaagaagatctacatatggaatctgaaggaattgtagacgtcacgaacggtgtgttcacgtaccagaaaatcattcaccgcccgtttatattattaaagccggatgcagccgaaacggattttacgctcgccaggaagttagcgcaaaaagcggagtcctcatgtatgatttcacgagcggtccaaggaaacgtggagatggagcttgaggttgaagtaaaagctgcccgcgcttgacgagttcaaacggtcagctccgggccgtttgatttttttaagctttttgagacttggaacggttcagcaggatgacgcccgtgatgaccaaaacaagcccgatcatcattttgactgtcatggcctccttaaaaacaaaaaagccgacaattgccgttaaagctgtgccgacacctgaccatgtcgcgtatgcggcggataaatcaaggcttttcaatgagaagctcaaaaacataaaagaggctccgattccggcaatgacgccgagagcgggccacaggtgcgtaaaaccgtccgacagcttcagcatcgtgctcccgaacacttctgatacaatggctaatgccaggcagagtaatcctttcatcagcatgcctctcctttctaccaattcatcaaaatgacaccggccaataagaaaaagagtccgatgacggcctgcttgtccagtttttcatgaaaccatttcgctccgataatggatgcgagcaccgttccggctccgctccatgttgcataggataagctgagcggaatgagattcagtgtcagtgaaagcatataaaaggccaatgaatagcctgccactacaagcgcgctcggcaaaaaccgcgtaaatccgcgggagactttcagcatggccgcgccgattgactctgataaaatagcaattgtgaggaagatataacccagaatcatatcaaatccccctctcatcataatccttatgccttttgtttaaggcagtaaaataaaataatatccgaactttgcccgccaagtcaagacattaggcctatacaaaaaggcccccggggaggagcctttttgattcgtcaatagaaatacggatagccgtagccgtaacccccgtacaagtacggattgaataaagcgcttccgacaagccccccgacaagccctccgaaaaacggtccgccgtaaaaaccaaacggccgtccgaatccataaccaaaccaaggccggccaaatccaaaacccggccgtccgaatccaaatccgaatccgggccgtccgaatccgaagcccggccgtccgaacccaaatccaggccgcccaaacggtctcatatcactatctgctgcgtatgtgtattcttcattcataattaaggtacctccaagaataaatttgagatgataacagagtattcagcccaccaatttttgattgggcgtttatcaaaaaaataaaggagtgagcttttgtgggtctgtatcagtccgattggtcaaaaaaacctccgcacacacacgcataccgggcggttacggatgttgtgcaggggcattaccatttgatcgaaggcttttcgcagccggagaacggcagcaatacagatgagcatacacatttctatacgggcatcacctcgtttgaaaacggccattttcataggtattacggcatttccggccctgccatcccgagggttgacggaacacattaccatgagctttcagagaccacctttgccgcctacaatgagccgattcagatccagcacggcggcgtcgtttacgatccgcgggaggaaggacggaaaacgcaccgccatacactcaaaggaaaaacgagagaagttgtcggaaacgagccgatcgggtggtagtggacgtttagcgctcaggaaaaagggcaaaatggataggtgcctgaagaaatgaatgctataattagggggagatttataaaagagagtgatacatattgaaaaataaaaaacagcctgtcgtcatactcgtcggaccgacggcagtcggaaaaacaaaactaagcatcggactcgcgaaaatgctgaatgcggaaatcatcagcggagattccatgcaggtatataaagggatggacatcggaacggccaaagtcaccgaagaagagacagaaggcgtgccgcatcacctgattgatattttggagccgtccgacactttttcaacggcggattatcagaaaatggtaaggggaaaaatcaccgagattgccggtagaggaaagctgccgatgattgtcggggggacgggtctgtacattcagtccgtgctgtatgactatacgttcacggaaaactccggcgaccctgtattccgggagcgcatggagaaactggcggctgaagaaggggcggaagcgcttcatgccaagcttgcggcagccgacccggaagcggcggcagccattcatcaaaacaatacgcgaagagtcatccgcgcgctcgaaatcctgcatgtatcgggaaaaacaatgtcagagcatcttaaaacccaaaaacgggagctgctttacaatgcggttcttatcggtcttacaatggacagagaagtgctgtacggccggattaacgagcgcgttgacctgatgctggaaaccggccttcttgacgaagtaaagcggctgtatgatatgaatatccgggacagccaatcgattcaggcaatcggctataaagagctgtatgaatatcttgatggaaaagtgccgctccctcaggctgtggagcaattaaaacaaaattcaaggcgatatgcgaaacgccagctgacctggtttcgcaataaaatgcccgtttcatggacagatatgacgccgcctgttgatattgagcagaaaaaaaaggaaattttcgagtgcatagcaggaaaactggaaatttaatcgaaacagtattgtattgagaaccaaggaggacgaaacatgaaaccgattaatattcaagatcagtttttgaatcaaatccgaaaagacaatacgttcgtcacggtgtttttactcaacggctttcagcttcgcggccaggtaaaaggctttgacaactttaccgttttgctcgaaacggaggggaagcagcagcttatttataaacatgccatctccacgttcgccccgcaaaaaaacgtccagcttgagcttgaatagactttttgacaaagaccatgaacaatggtctttttctatgcgcgtctgtatattgcaggccgtatatcggaaacataaaagggggtacggaaaatcgtgttcgaaagtgaaaatgaactgagaagaatcaggattacgctcgtttggatcgctgtttttttgctgtttggagcttgcagcaatcacgagacggtggtgacggatgatgacggcggcttggcggatgccgaaccgcagacagaaggcatggtgcagctggaacataatcgtttcggcattgtcgaggacggttacttaaaaatataccgctatgatgaaaaaacgaataaaatcgaactgaaaaaagaaacggcgctggatgagcttgaataaatttcacaagcgttcgaatttacaaagcgggccgcacaagctacactaagtactgacattgatcatgcagagggtgagacacgattgaaacacaaggtgataatcaaccattgggaagaaacttgtgaagatgattcctgctatgaatatggaaccagcatcatcgttgacggcaaagaactgatcagagaggcttccatcacaagcgctctgaaagccgtactgaaagaaatcggtgctgatgtggagattgaagaaaccgttgaaagcgaaaaaaaatgtgattcttacaaaaaataagaataaaagtctagactactaagcagttttttttcatgttatgatagacatcggcttacacatgacaccttgagtaggatgagagatgattctcgttctgctctcttttttgggcgttaatcgggccggagccaaagtccgctctttcaaaaatatgaattttttataaatcgatctcaatatgttgtgtttttctgggaggttagtatactatatatagtgttaagagattcattatttttgataggtcgtgataaggatggttcaaatcatatttgattcaaagacagggaatgttcagcgttttgtgaataaaacagactttcagctgatccgcaaggtggacgaaacggaccacgtggacactccgtttgttttggtcacctacacgacaaacttcggtcaggtaccggcatcaacacaatcatttctcgaaaaatacgcccatctcttattaggagtcgctgcgagcggcaacaaagtatggggcgataactttgcaaaaagcgccgataccatctctagacaatatcaggtgccgatcttgcacaaatttgaactcagcggcacatctaaagacgttgaattgtttactcaggaggtagaaagagttgtcacaaaatcaagtgccaaaatggatccagttaaataacgaaatcatgatccaacaagatggaaaattccagtttgataaagataaagaggctgtacatagctattttgtagactatatcaatcaaaacacagttttctttcacgatttaaaagagaagctggattatttgattgaaaaccaatactacgaagaggaattcttaagcctttattcttttgaagacattaaagaagtgtttaagacagcttacgctaagaagtttcgttttccttccttcatgagtgcgtttaaattctataatgactatgctttgaaaacgaatgacaagaaaaaaatcctcgagcgttatgaggaccggatctcaattgttgcgctgttcttcgcaaacggcgacactgagaaagcaaaagaatatgtgaacttgatgatcaatcaggaatatcagccgagcacaccgacatttttgaatgccggcagaaaacgccgcggagaacttgtgagctgtttcttgctcgaagtcaatgattccttaaacgacatttcacgggcgatcgatatttccatgcagctgtctaaattgggcggcggggtttctcttaatctgtccaagcttcgcgcgaaaggtgaagcgattaaagatgttgaaaacgccacaaaaggtgttgtaggcgtcatgaagcttcttgataacgcgttccgttatgctgaccaaatggggcaaagacaaggctctggcgcggcgtacttaaacattttccaccgcgatatcaatgactttcttgatacgaaaaagatttctgcggatgaagatgtgcgtgtcaaaacgctttctatcggtgtcgtcattccggataagttcgttgagcttgcacgtgaggacaaagcggcttatgtattctatccgcacacgatttataaagaatacggccagcatatggatgagatggacatgacggcgatgtatgaggagcttgtcgacaacccgcgtgtcaaaaaagaaaaagtgaatgcgcgcaaattgcttgaaaagcttgccgttctccgttctgagtcaggttatccgtacattatgttccaggataacgtaaacaaagagcatgcgaataaccacgtatcaaaagtgaaattctcgaacctttgctctgaagtgcttcaggcgtcacaggtttcggcttacacagattatgacgaggaagacgaaatcggcctggacatttcctgcaaccttggttcattaaatattctgaatgtcatgaaacataaatcgattgagcgcacggtgaaactcgcgacggattccctgactcatgtatctgagacgacggatatccgcaacgcgccggcagtcagacgcgcgaacaaagcgatgaagtcgatcggtttaggcgccatgaaccttcacggctacctggcccaaaacggcatcgcttatgaaagcccggaagcaagagatttcgcgaatacgttctttatgatggtgaacttttattccatccagcgttcagctgagcttgcgaaagaaaaaggcgaaacgtttgagcattatgaaggctccacttatgcaacgggagaatatttcaataaatacatcgaaaaagagttctcaccggcatacgaaaaaatcgctgcgctctttgaaggcatgcacattccgacaatcgaagactggaaagagctgaaggcgtttgtcgctgaaaacggcatgtaccacagctacagactgtgcatcgcgccgacaggctccatttcctacgtccaatccagcacggcgtccgttatgccgatcatggaacggatcgaagaaagaacatacggaaattcaaaaacgtattacccgatgccggggttagcgtctaataactggttcttctacaaagaagcttatgatatggacatgttcaaagtggtggatatgatcgcgacaatccagcagcatatcgatcagggaatcagctttaccctgtttttgaaagatacgatgacaactcgtgatctgaaccgtattgatctgtatgcccaccatagaggcatcaaaaccatttactatgcaagaacgaaagataccgggcaggacagctgtctttcttgtgtcgtttgattaaaggagagtttacagtgacaaaaatttatgacgcagcaaactggtcaaagcatgaagatgatttcacccaaatgttttacaaccaaaacgtaaagcagttttggcttccggaagagatcgcattaaacggcgatcttctcacttggaagtatttgggaaaaaatgagcaggatacgtacatgaaggtgctcgccggcctgacactgcttgatacagagcaggggaacacgggcatgccgattgtggccgagcacgtcgaaggccatcagcggaaagcggtgctgaactttatggcgatgatggagaacgctgtccatgcgaagtcgtactctaatattttcatgacccttgcaccgactgaaacgattaatgaagtatttgaatgggttaaacaaaataaatatttgcagaaaaaagcgcaaatgattgtcgggctttacaaagccattcaaaaagatgatgaaatttcactgttcaaagcgatggttgcttccgtctatctggaaagcttccttttctacagcggtttctattatccgttatatttctacggacaaggaaaactgatgcaaagcggtgagatcattaacctgatccttcgtgacgaagcgattcacggcgtgtatgtcggtctccttgctcaggaaatttataataaacagacagaagagaaaaaagcagagcttcgtgaatttgcgattgaccttctgaatcagttatatgaaaatgagcttgaatatacagaggacttgtacgatcaagtcggactctcacacgatgtaaagaaattcatccgctataacgccaataaagctttgatgaacttagggttcgatccttactttgaagaagaggatattaatccgatcgtattaaacggattaaacaccaaaacaaaatcacatgatttcttctccatgaaagggaacggctacaaaaaagcgacggtagaaccgattaaggacgaagatttttattttggccaagatgaagagcagatataatatctgctcttttggcttgaatggagaggtaagacaggaggaacgggcatgaataaaatggatgaaatcatcttggctgcaccgcggagtgacgtctttcaaaacgaaatgctgacatttcagggagtcaacagcgaggatgaacgtatcgtaaacattatggctcaaattgaggcgcatttttttgaaatcagaagaggcgacgcggaagaggacccgcgatttaaacagccgattccgtatgtcgtcatccgccgcgatgatgaggtgtttgtgtatgaacggcttgcgggcggaggggaatcgcgcctccataataagctttctctcggtttcggcggacacatgaaccctatggaaggggcggcttcattttcggaagtgctgaaacagaataccgaccgggagctggcggaagaactgtacattcgcgaggaggacaaacaaaacattgtcacactcggcctgatcaatgatgatgaaaacgatgtagggaaggtgcatatcggcatcctttctgcgctccagttagcgtctgcggcacaagtcgaagtgaaagaaaaagatcaaatcgccgggcgctggatgaaactgagcgaactgaaagaggaaaatgtgtatcagcgtcttgaagcttggtctcagtttgtcgccgatatactttaataacaaaaaacccccgttcgtcccaaaaaagggagagcaggggttttttcatttagtcttgcacaatgaaggcatcaaatccggctttttcggcccgtgctgccaacgcttcagcattatctctggaagagaatgcgccgatctgcactttaaataagccgccttttggaagcacaatcgcgtcaaaacctttagacaccgcatcggcggcaagcgcatcagcatttgctttcactttgaatgcgccgatttgcactttataaaagtcagcctttttttttagaccgaaagcttgctccaagcccttggcatgtcctcttgcaaggctttcaataaaactggctgttttcagtttgtttgcatcagctgacgtatcaacaaaaccattctccgtcaaaatcgccggcatacttgtctctcgcagcacatggaagttggctgttttttttcctcggtcattaaaacctgatgcttgaatcacttgcgtgtggacggctgattggtaagtcgaggtcggcgctccgacaccggggtaaatatagctttcgaatccggttccgcctcctgagttaatatgaatggataaaaaataatctgcgccccagctgttggcggcatccgttctttccgtcaggctgaccgtcttatcgcttgtcctgctcatcgtgacagaaactccttcatactcattcgtcagaatcgtgcgcaaagccagcgcgatctccagcgtgaccgctttttcctgaagtccgtttccggttgcacctgaatcagttccgccatgaccggggtctataaaaattttaaccattctccatcacctcattacagcatatgatgatattcaaaaggtgcttgtacggctgtcattcatgaaaaaaatgagaaatatacccaacatttcccggaaaataaaaataaatggtttgtcctcccgtttctgctgaatacaataagaaatgaaaaatatttctcgggaaagcgcaggattcaacatcattcccgaagagaacggaaaaagtgacagataaagaggaaaacaggtctcatgatgataggcggatgtcacggaaccgcttcatcatgagtaagataaagagagaacagagaggtgagcatgttggagcgcgctgtaacctataaaaataacggacaaattaacatcattcttaatggccaaaagcaagtgctgacaaatgcggaagctgaggcggaatatcaggccgccctgcaaaaaaatgaagccaagcacagcattctgaaagaaattgaaaacgaaatgaacacattagtgggtatggaagaaatgaaacgcaacattaaagaaatttacgcgtggatattcgtcaaccaaaaacgggccgaacaagggctgaaagtcggaaaacaagctcttcatatgatgttcaaagggaaccccggcaccgggaaaaccaccgtcgcgagactgatcggcaagcttttcttcgaaatgaacgttctttccaaaggacatctgatcgaagcggaacgtgccgatctcgtcggtgaatacatcggacacacggcgcaaaaaacgagagatctgattaaaaaatcgcttgggggtattttattcattgatgaagcatactcacttgcaagaggcggagaaaaggatttcggtaaagaggcgattgatacgcttgtcaaacatatggaagacaaacagcatgaatttattctgatcctggcagggtactcgagagaaatgacacatttcctgtcattaaatcccggcctgcaatcgcgtttccctatcagcatcgattttccggattactctgtcactcagctgatggacatcgcaaagcgcatgatagcagagcgggagtatcaattaagccaggaagccgagtggaagttaaaagattacttaatgacagtgaaaagcacgacaagccccattaaattcagcaacgggcgctttgtcagaaacgtgattgaaaaatcaatccgcgctcaggccatgaggcttttaatgggagaccaatatttaaaaaacgatttaatgacgatcaagagccaggatttacttataaaagatgaggcggcagctcacgaatagacctctcagccggtctgaggggtctcttttttatttctctctttaaaacccgccggatgtgtggtatacgccctgcgggtttggtatgatagtactactgcccaatacgacacagaaaggaacatccatttgaacgaacaggaaggaaaaaaagaaacggtcattttggtcggctgccagcttccgcacatgacagatgaacactttgaacattccatggaagagcttgcttcattgacaaaaacggctgacggaacggtgctgacccggattacgcaaaaacggaacagagcggatgccgctacatatataggcaaggggaaagtagacgagctgaaggcgctgtgtgaagagcttgaagcggatctggtcatttttaatgatgaactgtcaccgagccagcttaaatcacttgccactgcaattgaagcgaagatcatcgaccgcacgcagcttattttggatattttcgcaaaaagggcgaagacgagagaaggaaagcttcagatcgaattggcccagcttcaatacgcgctgccgcgtctgagcggacaaggaatcaatctctcaagacaaggcggcggaatcgggacgagagggcccggtgagacaaagcttgaaacagaccggcgccacattagaaaccgcatacacgaaattaacgtgcagctttcaacggttatccgccacagaagccgttatcgggagagacgaaaaaagaacggcgtgcttcaggctgcactcgtcgggtataccaatgccggaaaatcaacatggttcaatcaattaacgagctcagacagctatgaagaagatctgctgtttgcaacacttgatccgatgacgagaaagatggcgctcccaagcggctacagcgtccttttgtctgatacggtcggcttcattcaggatctgccgacgacgctgattgccgctttccgctcaacacttgaggaagtgaaggaagcagacttgatcattcatgtcattgattcatccaatgaagattatgccgggcatgaacagactgtcctcggtctgttaaaagagcttgaggcagatgatattccggtgctgaccgcttataacaaacgtgatgagacacttcctgacttcatcccgacagcgggagaaggccacatcatgatcagcgccagaatcgccggggatgaagcaaaactaaaagcggaaatcgaagcttatttgcgccaggagctgatgacgccgtatgaagttcatgtgcctgccgccgaaggcaaattgatgtcacgcatcaaatcagagaccatgatcgacagcctttattttaatgaagaaaatgaacgctacgaagtctcaggttatgtacaggaagaacaaagcatactcggagaactgaagaaattcatgtaaggaaggtatacacaacatgtttgacacactgacccacggcgctcttttacaaaaggccgccgaagaaacagaagcggaaatctccgccgttcataaaggaatagaagaaatcagtgaacggaatgaatggagagtcctgcaaagctacagaaaacataaagtaagcgatacgcattttacgccttcaacgggatacggttatgacgatatcggacgagatacactggagaagatctatgctgatgtgttcggaggagaggcgggactcgtgcggccgcaaatcatttccggaacgcatgcgatttcaatcgcgctcttcggtgtgctgagacccggggacgaattgctttatattacaggcaagccttacgatacactcgaggaaatcgtcggagtaagaggcggggagtattcaggctcgcttaaggaatttcaaatcggatacaatgcagtcgatttaacatcagaaggcagagtggactttgaagcggtccgggctgcaatccggccgaatacaaaagtgatcggcatccagcgttcaaaaggatatgcgaatcgtccgtctttcagaataaatgaaattgaagagatgattcgtttcgtaaaggaaatcaaagaagatgtcattgtttttgtggacaattgctacggagaatttgcagaagagcgggaaccctgccacgtcggagcggatcttatggccggctccctgattaaaaacccgggcggcggccttgctaaaacgggcggctatcttgtagggaaagccaagtggattgaggcctgctcttaccggatgacctccccgggaatcggaagtgaagccggggcttcgctttattcactgcaggaaatgtatcaaggtttctttctcgctccgcatgtagtggcacaaagcttgaagggagcggtattttccgcccgttttcttgaaaagctcggctttacgtcaaaccctgcatggaatgcgccgagaacggatctgattcaatcagttgagtttcaggaccctgataagatgattgctttttgccaggcgatacaatatgcttcaccgattaatgcgcatgtgacgccttatccgagctatatgccgggatatgaagacgatgtcattatggcagcgggcactttcgtacagggagcaagcattgaattatcagcagatggacctatcagaccgccttatgtggcgtatgtccaaggaggattaacctacgcgcacgtgaaaaatgcgatttgcagcgccgtaaatgctttaatggaaaaagagctgatctaggccgtttgcaattttcaaagaatttgatgttaaggttccttacattgtgttgacacaaaatataacatcacctataatgagactaagataagaaaaggaggaaattgagatgagtgataacattcgccgctcaatgcctttatttccaattgggattgtcatgcagttaacagaactttctgcccggcaaattcgatattatgaggaaaatggattgatatttccagcgagaagcgaaggaaatagacgattattttcattccatgatgtagataaactgttagaaatcaaaaatctgattgaacaaggcgtcaatatggcggggatcaaacaaattctggataaggcatctgccgaaccggaagaaaaatccgaaaaaaccgccaaaccgatgaagcacgatctgtctgatgacgaactcagaaagcttctgaaaaacgaactgatgcaggcaggccgtttccagcggggaaatactttccgccaaggtgacatgtcccgattctttcattaatccgttagcaactgttttgctatatacatttaccttttagaggaggagttttacaaaatggcaaagtacacaagagaagacatcgtaaaattagtaaatgaggaaaacgtaaagtatatccgccttcagttcacagacattctcggaacgattaaaaacgtggaaattcctgtgagccagcttgaaaaagcacttgataataaatgcatgttcgatggttcttccatcgaaggttttgtccgtatcgaagagtctgatatgtacttatatcctgatctgaacacatttgtagtcttcccatggacggctgaaaaaggtaaagtagcacgcttcatctgtgacatttacaatccggacggcacgccgttcgaaggtgacccgcgtaacaacctcaaacggattctgaaagaaatgaaagaactcggtttcagcgatttcaatcttggacctgagcctgaattcttcctgtttaaattagatgaaaaaggcgaaccgacgcttgaattgaacgataaaggcggatacttcgacctggctccgactgacttgggagaaaactgccgccgcgatatcgtgcttgagcttgaagaaatgggctttgaaatcgaagcatctcaccatgaagttgctccgggtcagcacgaaatcgattttaaatatgccggtgccatccgttcttgtgacgacatccaaactttcaaactggttgtcaaaacgatcgcccgcaaacacggtctgcatgcgacattcatgccaaaaccgctgttcggcgtaaacggttccggtatgcactgcaacctatcactctttaaagatagcgttaacgcattctttgataaagacgctgatcttcagctgagtgaaacagcaaaacatttcattgccggtatcgtaaaacacgcgacaagctttacggctgtcacaaacccgacggtgaactcttacaaacgccttgttccgggctatgaagcaccttgctacgtggcatggagcgcgcaaaacagaagcccgctgatccgtatcccggcttcccgcggcatcagcacgcgtgttgaagtccgcagcgtagacccggcggcaaacccgtacctggcgttaagcgtattgcttgcagcaggccttgacggaatcaaaaataaacttgaagcaccggctccgattgaccgtaacatctacgtcatgagcaaagaagagcgcatggaaaacggcatcgtagatcttccggcgacactggcggaagctctcgacgaattcaaatcaaacgaagtcatggttgcagcgctcggcgagcacctgttcgaacacttcatcgaagcaaaagaaatcgaatgggatatgttccgcacacaggttcatccgtgggagcgcgaacaatacatgtctcagtattaatctctcaatcccttggcactattggtgtcaggggattttttggtttatttcacaaggggtatttgaaggattggtggtcaggttgaccactatttgaccaccaaaaatactaaaaaaaattaagacaaaagagagttcatatattcttcataaccgtcaactgacgaattttcaagtttctctgagatatgagagtacacgtcagaagtgatggttatatttttatgcccaagtctttcttgtacaaacttcatcgttgcaccagattcaagaagaagaacggcgtgagtatgtcttaaaccatgtataggcattttattaagcccagactttttaagaattcgattaagtgcattgaagagggtggatttcggtaatggtttgccgtcctctctgcaaaaaacaaggtctaattcatgctcatatacttcattaaaaactattctattatcatttaaatatttcatatgagctgttaattccttagccaaagaattgcttattttaatacgtctctcggattcataagtttttgtttctccgaatctttcttcgccttctttaacttgaaagtctaaagatttgttaatatggatgtaattattctttaaatcaatatcctttctttgtaatgcagcagcttcccccttacgcattccagtttcaagtagagttttaaagaaaatgtagtaaagatagttatcctgtcttgcaattttgaggaagaaggagatgtcgtctgagttaatgtacgccagtttttcttttttcttaggtatcttcgggatagttactccttcacaaggattctcctcgagtttctttaatggttttacagcagtagataaagcattaaacattgtcccgtgaatgatctcgatcgttctcttactgtacccttgttctgctaaatgattgatgaatttttggtatctcaaaggcttgatatccttaagcttaatatccttaaaatagggcaagatctttgttttaacattacgttcatgaaggatatatgtgtttttcctaacagttccttgtttatattcagtgagccaatctttaagatagtgttttaaaagaacgtcacctccattgatttctaagtcgctattcagcctcagttcttcttgtctggctgctagttgtgcttctttttttgttttaaatccacctttagagacctcaatttgttcatgagtcaaagggtctttatgctttattctgtattgccaggtactacctctttttctgaaactggccatctttactccacctttcataaattaacatatcccattttagcacttagtttttcgggggacaatcaaaaatttcagacaattgaaagttaacgttatcaaaaaatactataagtttgtgtttattttctgctcttgatataagataattgaaattgtggtgaattatggagtgagggcaaacttgaagttttatggtcaaatggatttaaacattctcgtataaagtatagtgtagtcataaggggctgtaacagtgatgaaaaagaagaaaatgattatttttttcggaattgtggctatagcaataatagcattgtctataacaattccaatgtacataaacaggttagatacaaccaatttagatgctatagctactaaagtaaaagaaaacaaaaaattaaacaaacactttgattcagtatggttgcgtaaagttcaggatactaaaaatcaatttgatttatctttaaaagctaagccagcgtttactactttatctgacaaagaaaaattgcttttggctggaaaggtgatggaagttgtccaaaagaattcgcatttaaacgaaattaaatgtggaaggaataaaacatgttctattaatgagatttttattttgccgagcgatgaagacgataaaacatccagttatgaagttaaatatagtccattaaatcatccagaagagaacgttttaatcgtaagtgaataccaaaatgatgaccctaattctcatatacttgaaacaagagaagtgaagtaccaagaagacgggtacgaaggcgtagacaccctagatgaagattatcaggagaagacaattgctattggcatgaccaagcaggaagttgtccaacttaaagactggggcaggcctaagtctattcataagacaacgacagcatcagggataaatgaacaatgggtttacggtattagcagatatctatatttcgataatggagtattaacaacaatacaagaataaaattattagcccttcaatccaaacattaaataaaaaaatcctcattttaacgaaacattttagatcatcttgcttattaatctaatttaaagtatcctaattgatgtatcataggggtttaacagccactatagaccacagagtccctcacacgctctgtggttttttgtttagacagaatatatccaaataaaaaaagaagcctcagagggcttcaaattgattaattcttctcacatgcaaagttgtcattatcccgatccatcttagatgtataagcagggtgagtgcttggtactccatgcggatatttctttctcagctctgtgcagtttgcaaagtgttctgttcctccagtagaaggggaggcttgtgtagagttagaagagctgtttgatgccgatctatttgaatgtgaactgcttggattagacgatttatgcgtctctgattggtgtgttgtaactgacttttgagccggcttagatacacttactgatttcttcggtttcgttacgcagccattaaatcctttatcagtcgcatatccattcttactccaaatcttcaagtccttatctttagcagcttgctcatctttcttatacgtgtctaaatacttcgtgtttggttcatatacataagctactcgtgctaatccttctttaagcagtgtttcttgaacagatttgccatctacataaacgtaaaccagcagtctgccgtacttgtctgtacgatctcctttatcaaactctagttgaagcttgccattgttaactagctgtttgtttcttgttgaagcatcctcaccatatggttgtacacaagagtttggctttttagtctcaggagtgtcaacaagtaaataacgaactgttttgacttcgcctttatagttaactttaatcgtgtctccatcaaccgttctgtttagtgttacatcgaccaactttttcttattgtcagatgccttgttatccgacgaatccttctttgaagcattttcggctttttcatttttgtcattattgcttttgtcgtttgattgagagtctgtctttgtctcttttgtatccttttcttcttgctgcgttgttttagccttatctgaatctgttttatctgtagaagcagaatcagacccacatgcagccaaagaaaagcttagagataatgcgccaatacctaataaccatttcttcaatgtaattcccccaaatttgtttattctgtctttatatcggacaaaccttcctaattataattatagaaccaaagattgtaaaattaattttaggtaaacatctgattttgaaaatcgaagagcctaaaactatggtaaaatttagaaaagattaagtggaaaggagacagatatgaaagtatttgaagcatcctcgttaatctcagcagcggagaaacgagcaaaagaatacgatcagattagagaacaatttatcaatctcagaaaagcgtttcagggaatggctgacttagacgatagtgagttttcaggtaaaggtgctgataacattaaagcattcttccaagatcacgctggtgttacagacagctggcttgatctgatcgatatgaagattgcttttcttaacagtatttcaggaaaagtagctgatgccggattagccgattcgtttgtggaagagtcatttttagaacatgagttgatttatgcgaagaataaatcaaaagccatcatgcaagagcagcggaatgaaatgagggatattcttaatgagataagtgatattgttcatcttgatgttttctctacagaggatgtcgatcaaaagctggattcagcagacaaaaaacgggacgatactgtacataagctcggcaagcttgatcatgatctaacgaaagaatacgcagaaaccgaagcaaacgaacagttcatccaagccgactttcagcagctccaaaacgctacgggaaaagggaaaaacgcaacaccacttcactataatgccgaggcgtacagagaaagtgacatacataagaaaaaaggcgagattgcaagacactcagacacatatttaacgattaagaaggaagaagcgaaagagcgggaaatcaaggatttggagaaaaagctcgccgatggagtaactgattcggatgaatacttagagattgcgaagaagatcggttacgagaaccttgaaccttcccaacagcaatatgtgatccagcttgaacaagcaaaacagatggaagaagccggagaagtgacttgggatattttaaaaggggccggcgttggtttatatgatgtcgggaaagacacggtaaccggtttatggcagctgatcagcaagcctgatgaagttgttgaaggtatcataggggcagttgctcatccgattaacacgtataattccatttcaacagctattgaggaatcatatcaaaaggatatggtaaatggagatgcttactccagatcaagatgggtgacatatgcggtcagttcagtggctgttgctgtcgtcggaacgaaaggcgcaggagccgttaacaaagcagatgcagcaggcaaggtcataaacaaggtagggcagacaggtacgaaattgaaggatgttaaaattccggatttactgccatataatccaaagtataaccttgctctgacaggtgacgtgccatacaatgtagtggacggagcaaacttaaaaaatcaactaatgagttttgctaaaaggtcagataaagaagtaaaacctttcgatgtcgtagattatagaccaagtaacagtcctttagagaatcatcacggtgtaatggatgtatgggctaaacataatgttccgaattatgtgagtagaggtagtaatacgccaacagtagctttaactaaggaacaacacaacgctaccaagaaagtatatagagaatggttgttcgaaaaaacagggaagaaagttggcggcaaagtaaactggaaagaagtatcccctagagaaatacaagaacttactgagaagatgtttgatgctgctaatgttcctaaagaagctagacagcaatattataacgcatttaatcaatacaactttagaaagtaggtgcggacttgagcattgatatgttaatcaagaagattgcttccacatcaggctgtcggctgtttgaagctgatggtctcccagtaatagacgagaagcatcaactaccaaaagatattagtgaattttatgaacaatgtggtggagcagttttatatgaaaatgcggattatccaatatacatagtacgaccagctgagtttgaattggctaatcccattattgttggggagctctgtgaagaagacatttcatccgagtggtatattgtttgcactgatggaaaaggtgaatacctaacaattgacttaaacgaagagcgaaaagggaaatgctatgacagcttttttgatcgacatggaatagtcggcgaaacacaggtgatagcaagttcatttacagatttaatacagcgactgcttgagaataagggtaaacattggtattggttaagggatgattatgtatcactaggcgatgcatatgatggcatagaaattgaataatctattaaacaaaagtattgcaattgttcattgctaaagatgtgcaatgcggaggggattaatatgagcttcaataatatcaaacaaaagttgaaagagttttcaattgttgcaaaaacagatcccagaatcaataaaaatgaacaactcaaagaaattgaaatgaacataggaaaacaattaccttctgattataaggactttttgaagaaatatggcggctgttatctagaaagtacaaaaacaacagatgaaattgagtatgacgtttgctataaacctttagagaaagatccttggatgggcaagggcgatgatacacaattgttagaaggtttttatggtttagcgaacgatcataacagtcttcagaaagcaatcgatacatattctgatcgctttcctagaaatattattcctatcgcaagctctgcaggcgggaatgaaatatgcatggatatcgataatggaaagatattgttttgggatcatgaattaagtcatcccgacaaagactttttcttaattgccaattcgtttgaggagtttgtcttcagtttagttgatgaaccaattgaagctgataaagaagatgatggaattctgtatattgaattagatgatgacttactaagcagttaagaaaacgtatggaaataactggaggaaaagttaaaatggcagttacttattggacaggggagaatcttacactgcgagcaattcaacctgaagatatcgttatatttgattcgttagatgatgaaattctgcgaaatatggactcgctacattttcctcgttcagctaataacatgagagaatgggtagaagaacaattagaaaaagatgaattccgttttattgcagttgatagtgataataatatagtaggtataattgaaacctttgactgtgataggaaaaatggtaccttcggttattatttggctgtattcgagccatataggggaaaaggatttgccaaagaaatgatcttgatggttcttcgctttttctttttggaacttgcttatcaaaaagtaaatacaactgtttattcttttaataatccatccatacgattacatgaaaaattaggtttcatgaaagagggacaactaagaaagatcattttcactaaaggtgcctattatgatggtatttgctttggaatgacaagagaagaatttgaactgaatcatggataatatcacttgtgcatcgataaagtactgggttccaataaaataatggttttatccataaaacaaaagttttgcaaatcatttcaatggtttcatttaatgtgttataatcaaactgtaaaatacagactggttacagtgtatttctttaataagaaatgcataaaataaaaagaccagggtgttggtagcaccccggctctgtacaaaaagctacccatcaaagggcttgctcagcagttattcgtgatagacctgtcccttcaggattccagtctcaagggaggtctattttttatttatatacgtcaacagggcgattataaacgacccaaatgcaagcattaacattaatgcctgaaatgttgacataagcatcaccccctttcgtaggggatgagcaagactcccttgagtgagcaaacttaatgtacaggaatcattatacactagttccatttatatgtcgttaaaaacctcatacagttacctaaacgaaaagaaccatgttagaaataggttctttttttgtatttaagttaaatatctcgctggaattaccgataaataacatgtgaaataataccaaggaggttgtgaaattgaaaaaagtatttagtttagtaacaattgtacttcttgctgttgcaacgatgttttctattaacacatcaaaagcagaagcagttgaagcaacaccgctttacagtcttcagattctttctgtcacatcggatggaaacgactttgtatgggagcctattacaagcagcaagccaaatgcaacaaatgttttgaaaggtgacaagctgcatattaaagttcgctttatgggctatacaaattcgaccgttattaaagcaaaggatgggagaaatttgttatacaaaggtgaagcgaacatatacaaatatgaccctatacttggacaaaacaaagttgtgataggatgggacaaatacattgaaattccaatgaacgaacttccttcaaatgagattcaagttgaaggtcttgggaaaaacatgaaaatcatttatagcaacgttgtaaaattcgagagagggtgaatgttatggaaggtctaaataactcttacaatattacgaaagatccgaaatttttagcgttttgcagtttagcgacagaaggtgcaggaattagttcgaatcagcaatgttcaattggttttaatgaattcaaagaagcgctggagaatggcaaagtagttgataataaaaaccttaaaagcagttcagagttaaatcaccagtttgattactggaagtccagaataactgggggacgagttgtaactgaaactgataatcaagtgctggatatcatcaaacaagcatacaatcttggaatggttacgaaagataatatgcttttgagaaatcaagcaattaacgcttataaaacatctatttaatttaaaattaaagccccttcctacaggaagaggcttttgctttgcaacttattctttaagtttaatctaaaaccataaagtcttgcacttttgtttcttcttcaggtaaatcaaattcatcaagtttctttttagtacggatatcaaaaatccccatatagccaccaaccccttttttgttttcctcttgtgaaatcacataaagtttttgatctttaaactttgcattcatatatggaaattttaaatcgaattttttaaaagaaaaatccttactgtactcaagtaagccggcgtatccggatttattaatatatgtaacgtaaaatttgccactttttttgtcgtaatacactgtgtccgcttgttcgagatcatcaggatattttatgaattttgatttccatgatcctttttcgattacagttagctcatgctctgagctagctacaacgtatttttcagagtgatcaaacaaatctccataggaagctaatccaatcgttttaataatctcttctgtgtttctatcaatgacgtacatagacattccttgaatgacgtaaatatacctattatcgctttctcccatggttactagggaaggcaaagttaggctatattttttattgaactttttatcatttactttcagttcatttccattggtgtcgacattataggcttttacggaaatatcctctccttgataccaaaaagcaaatggattggacaatttatgttccttaatggtgttgttttttaatgtgtaataatatggttcatgttcagctaacaagacgatatcgtttgaagagagggtttttttctggatatatggtatatccggtaccttaaagtatcgtttattaaattcttctccttgtgatgtggatatgagtacgcttttcttgatgagtggatttgaatagataaaaaagattttatcctcggttggattaattttagaagtacttacagagtattcacctttatttataaagaatgcattgatcaacaatataactattgcaccaattagaactcctgaaatcccatataaaacataagactttttcatataacgctccttatcttttatataaaataaaaagacacttgcagaataaatctgcaagtaaaatgattagtagctaacagtttttgatgaacgatcaatatctgcaggtgtaacaagtgcgcctccattactgtctaggtctgtcccttttgtgtttttgtatgattgccacacaagtttagagcaataatatttatttgtatttttcttggttgtagctactgaataaggcttacctgttttactactagcatatctctgagcctttaccttatcatagatatctgcgcccttaacatactgtttctttttgcttttgaatcgcttactccaattgttctgataattccttacaccctttccggcccatgcttccataatccttgaattatcgctttgcacaatagcatcgtgaccgtgcctccagctggaagtgctattatcatatgttgtaagtatatctccaactttacccattttcccagaggcatatgtcttatttctttcgcctacaatttgtttatattcatcagggttttcttttttcaaaagttcaagttcttcttcgatatttggatcaacttctggactattcttagctttttccgtatcgatgtctgcttgtgcaagttcttgttgaatttcaggcgaggagagatcgagggtgtcttcgctatcatcagaagtagcattaatagagtaagaggtaccgattgttaacaaagtggtcattagaaaaatagtaatcttcatcttcatttttaaaatcatgtcctttcaagaaaatatggttatgtacccaatgtgttgcacgaaacctcctctctattacctagactaggtacagttaatttatatcatgtattacatttattaacaataattaaataaattgttaagcttgatttaaggttttaagttttttaccaacaattacatcgaaggttggatagggttattttatttaagggcggttttcttcacatatctcatcaagaaaactaccacagactttgactgaaacactctaattccaactgtcttaattttgtattgatgttaccgataatacaaataaaggggaagggagagttttttgaaactgtaagcttttccattctcctgaattaaagaatgtctgatcccttgacacttttcactcatcgaaaagcaatgctttgtgctggagtttttaagtgtgaaaataaattactatgtccccccttacaagcatacattgtgatatgtaaggggggatttttcttgcctagataccgaagagctcttcgcaagagagggcctttgccttttcggtatgtgcttcttctgtcgtttgctttttttaccatatcgacggtcatcagcctttggatgatcaactcctcaatcaaaccgatgctgatgaacataggagaaatggaaaccaaacgggtggcgacagaggtcattacggaatccattgaagaatacatgtctcacagcgacaatgtgaaagatatggtcgatatgaaaacggatgaaaacggaaaagtcacaacgatggattttaatacacaaatggtcaacagtatgaaggcgaaagtgacaaagcagctccaggctcatctgaaggaagtggagtcgaacaataagcaacatgaaacagaaaaaggcgcaaaaacggccgatgaaattatgattaacatccctttagggcaggtcacgggaaacagcattctcggaaatctcgggccgaaaatccccgtgcgctttaacctgatcggtgatgcgttaactgatgtgaaaacaaaaataaaaccgtacggcatcaacaatgccctgattgatatcagtatttttgtggaaattaaagtgaaggtcattattccgtttgccagtaagacatcagtcgtgacaaataatattccggtctccattaaagcgattcaaggagaggtgccgcagttttataacggaagcggcggatcaggtgtcacgccttccattcagctaccgaatgaaaaaaaggagaaatccggagccaataaagacaaataaagacacacagctgccagaaaagaatgcggctgtgtgtttactttttcctgcggatttcttttcgctcttggagataattcaatgcttcgactagagcagctcataaaggctagtggatatttaatgattagtcatttccaacaattacatcgaactatcgttcttatttatattgaataaagaacgtttgttctgttaatattagatcaataaaggagtgattcaaaatgcttagagatcgaggaacaatcaaatggacttccatgatgcttccagaacatttaacacaactaaaaaaggacttgttagatgttttgaaaatggagaagccatctttagatgaacaacaaattgaggagattgacatcttggtttctgaagcaatggcattgaataaagaactgaagtttaagctctttaaagaaggggttgctgaggatttaatcggtacagtccaatatctcaattacgaacaacacaaattacatgtaaaagatcatcacgatcaaaccgtatacatcaccatgaatgacatcataggagttgcttacaatgattgattactcacagtttccacgtaaaaatatactttgtgtagatatgaaatccttttatgcttcggtttcagctgtaacaatgggattgaatccaatgacatgttatctcgctgtagtcggaaacacggatagacaggggagtgttgtcttagcagcgtctcctgcacttaaaaaagattatggaatcaagactggctcccggctatttgagattccagatgatccaagaattcacatagtaaacccgcaaatgaaacttttcatcagagtttcaactgaaataactaaattgttttacaggttcgttcctgaaacatgtgtacacacgtactcaattgatgaatcttttttagatgcaggaaaagaaaatcctgaagtcatggcagaagcaattcagagcagtatgaagagagagttcggcttagtttgtactgttggcattggcgacaatatgctgctgagtaagttagctcttgatttagagagcaagaaaacaaagactgggattgcacggtgggggtatgaagatgttccgaaaaaactttggcgtgttcatccgttatctgaaatgtggggaataggagggaggatggaaaggaatttaaaccgaatggggattgcgactgttggccaattagccaattatccattagagctgcttgaaaaacgtttcggcattatggggaatcagctttattatcatgcccatggaattgacctttctgaaattggagctcctttaatgcaggggcaaataagctacgggaaaagccagatattacttagagattatacgaagaaagaggatatcaaagtagtcctcttggagatttgtgaagaggttgcacgaagagcacgaacacataacaaagtagggcgtacgatcagcttaggaattggttacagtaaagatgagttcggcggtggctttcacagatctaaaacaattgatttgcctacgaatatcacaatggatatttatcgatactgcttgattttgtttgataagttctatacaggaaaaacagtaagaagtatttcagttactttatccaatattgaagacgatgtgaatcagcaattaagtctgtttgaaaaggataatgagaagagaaggaagcttggatttgtgatggacgggataagaaataaatacggatctaaagcgatcttacgagctgtttcatatacacctggtggaacagcattgcatagagcaggtttgactggtggacataagtcatgagaacagagagcagctccctctgttctccttacaaagttattagttttttacgtttcggctctttcagcaaccttgaacgtatcattttgttgttggagataggaagcacccaatgttccggcaacgccgaataatagaactgcacagataaatagtttagttttcatattgcttctccccttttgatttgtcttcttgcttcatttgccaaacgataaaattcaactgcaccccaagcatcctgttttccagtgagaaaatctgctacagagacaccataactttccatgtcagggtatatacctctttctttgaagaactcgaatgttttcctaactaagtctaaatcatagtccaagaaaagtcctttaaccatttttaacttttcaagtaccatttcattgttatgccgttcagccagctgtttggcctgttcataaaatttttttgcgttttcaacgtcattttgccttccctttaagaaggagataacaaataatgtcttagcagcgtaatcatgattttccggctcaatgatttgaagtgacttattaaagtgaaaaaatgctttatcaagttcttccatttgattataacacaatccaatattaaacagtgctgaacgcatcaaatgcccacgattcttttcacttttgtttagctctactgcctcctgatacgctttgtatgcttgctttaaagcttcatcaaacttcatactgtccagcaaattaccaaatatgacgaattgacagcgcaccttttgtaccccgtatgtagggttcccgtcaatagcaggttgttttttaaatatatcgtaagccctcatggcataattcattgaaaaataagtctgtttcatgtggtaatacacttctgacaatttaaaataaaattcagctttttcaacttcaatatctccactctcgattgaatccaaatacctctcagcttgtctatagtaattaagggagaatgttaactctttttgtctgaaatagaacatgcccatgaaaaagtaatagtaatattccagcattcctgttaaatttccatgaccttcatattcttttagctcgccataatttttctcaatatcttttatagcgttaggatacatatatgccaacattagcttatgtctaaactcaagtagggagtagtatagtaaaacatcttgattttcttccataacttttatttcctgcataacttctttacgcatttcttctgctctaccgacccaattctttttaatagccacataccaatgattcatctttgttgctactaaatcataaggaatgactttttcactcttcaagtcctaaacccctttcatatccattttattatatagttgcattagaggaaagaaatgtaaaggggatttgagtgaaaattaaaaacaaatcaataatttgtttatgaccgaaacgaaaaaaataccctcctcgttagagaagggtacgttatcagtttgctgttgctttcagtgaggcaagccactcatccaatgttcctgagaaaccttgttgaacggctaattcatatgctgattttccatctttaccggcagcaccagtagcacctttaaccccggttgcaccagtagctccagtatcgcctttttcaccttttaatgaagctaaccattcctctacagttcctgaaaaaccattgtctactgcaatatcataagcagacttcccagtgacaattgagacattaaccattggattgaagaaactcatttatgcgcccccaaaaaattatatgttattcctgactcagaaattttgaagcttgtgataggtgaatcatgagcgtccatttgaaagccttgtccagctcttaaatagataggatcaccaccattgattgatacgtggcattcctgatcattcgaaaagctgaatttatagaaagaatatttaatcgtccaggttgcaggtggggaagggatcacttcatggttagattctgacttctcaagcattggactcccgatatatccagatcctatttgcatgaccaacaatcattcctttcttaattaaaaatgaaaaaaggggggatgaactcccccgagttattttggttctgtgtattccattgcttgatcactatctgagatacctgtagtggttggatccactacaattcccatggcagttaaaaatgtcagcagtgcattaaatttctcagtgagatcatcactaaacacagaaatatcgtatccaaaagctgatgcaattgcttgtgcaaacaaaagagttgcagagaagattgcaaccaggaatgttttcttttttagtcttactttccagttaattttagtcattaaatcgtctccttataaattagctaatttggtgatatcaacaccagcgatctctgcaccaagtagtatgaggataattaaaactaaaatctttaatgtcttgccaaatgttccttctaataagttttgaagccactttgtttgcgactgattaacttgctgaaattcatttcttagtccagctatctcagtggtgaacaaattttttgtttcaacaaggtttttttcttggttctcaacaacagtggtaagtctaataagtgattcacttgttgttttttgtgtttccaacatgatttttctatcttctgcttgttctttaagacgttcttttatatgagcaacctcagtctttaaaacttcatagttttctttttcagccacaatgcaatcatcctccataaaaaataggaggtaatgtcacatcacctcctaaataatcattgatacactttgagctacaatcatcctcaaagatatttaaatatatttagatttttgagccaaattgtcctgaaatgtagccgcgtttacctttgtagataacttcccagtaacccttagcattgtttgaccctttcactgagccagaaatgctgacggtatcacctagctccacagtgccgagattcttcgctttgtttttatcaggtctgtccattacgatagcagcgctttttactccgacaactttaatcttgcctacagatttgattccactgttatcaggcttagaagtgggtttaggctttggggttgattttccaagctcagcatcacttttaatgtatttcacatttacatatccgctgtatgtagcacctttggagtttgtatatttgatataaccccaaccattttgagttgatcctttttggtattggacagtggagcctttaggaagggcaagtacaatagaggagttcgcattgcgctgagttctcacattaagactgtctgcgataactgtgttcttaacataagagccatttgttttaacgacttttgttggctttgaagatgaggaagaagtttttccgccgagtacttttaattctgcagcaatggccgctttcacttgatcccaacgtccctcagacagaatacgatgcggacagtattttccgttccagtcctgatgctttctgattttgtcaacgccccatccgcgctctttgagaagctgcgccacaaacttgatagccagcgcttctgctgcgcggtaccgcgcgccacctgacttactgtagcagatttctactgcgatagacttacggttaccggttccattccttccatcgccagagtgccaagcgttccgatccagcggaatcccctgaatgacttctttatcatcgatggcaaagtgatagcttgtcgattcgctgtttcccgtcatataactgatttcattggcggctgatgcgtcgtttgctgtgttatgaatagtgatatactccggtgtcattgggttcggacatttcagggcgtatttttcacttagaactaatctctttttcactgcaattgtcatattgagcatctctcctaaaaattaaatttgagcacaaaaaagagagaagggggtaaattccaatctctctttatctcacgtatgctcttgttatctctgtttttgaatgctgtaaattgaataaaatttatattttaactagaacataaccacctcctttaattttgagggattacttaattaagcagatggcaatgccatagccaagcttgtctgaatatggggttacaatctccatagccttccaagagtaaaacctgtcttctgtttttgtgccgatgccataattaccttcaatacgatctcccacagaaacagtgctgtccactttcacataaacctgtccaagtaagccgactatgttccattcagggcgttcttcacgggggacgtaatctattttttcaatccattcagggtttactttaggcagtttcttaacatcaccggtttctgggttgactacatcttcatatatgtatccaccaaattcattctttaaatatctaccttgccagtgaatatcagctccgcctaaaatagttcctgcagtttcggagattactccgtgtacatcttcaccttttctcgctgggcgaattttagctccttcaagagtgacaattgttcctgtcggaattgcttttccgtcaaggctttcaaaatattcagcgtaatcactgaaagtggctccgccattcatcttgccggtagatgttatatctccgttcatggagtttagcatccatttgatattcgctcttgatggggtagaaccatatccaccaaccaccatatagcgatcatttgtaccgagtttgactcctcccgaagataagatagttcgtgagacattatcgccttcaatgtgggattcgtttgaagacatgactgtgctacgcgaaccgctaacggaacttgctccggaagaggaaaatactcctgttctgaccccagttgcttttgctccacctgtggtgcctataacagcagaagcttcacctgatacttcaggctgtccagtagatgctgctattaagcctgtgctagatttgggtactccagaagaggttgcaacctttgtcccgccttttatattatttggtacaaaagtgtaatcaactcctgcaattctggcagcctttttgtatttttccactgaaattcccattaggcttacctgagaattagaacaatatacaccaatactgtcagctttcccgtcgcctatcaaacttgcattaataagctttacattttctgtgccactgccaatacgcacaccgattctcgccgattcaaaacaatttacatttgaaatatttacattatctgatttttgatccccaccgtatacataaatatcagctccagctgttttgaagttagaaatagagagactgtttaaattgatgtttcttgatttaaattgcgtagcgattgcgggatttcctttgtaatcataagaagggtctccaattgcgttaaagtttgaaatgttgacatttctgtaagctgagattactagtgcccgtgggctcaactctttataaaggtcactaaagattggagacttcgcagtacagttaacaacattaatgtcgaatgcactagtggagattttatcagaagcacgatgaaagccgatgtgtctaaaatcaaatgcacgaatgtcattctctgagtagcagttgattaaatttacgtttcttgctgcaggcgctctattgtgggctttaacttcaaaacctctgcagtttttctgactgttgcagttcaccagccatacgtttctagaaccgtcatcaatttcaaaaccatttgaatttgatgagcctttgtcatgagcagacccattggcattgtatgcgtgacagttagtgaagtagatgtattcagaatagtgagttgtgaagccatcgtcaccgaaattagttgcagtacagttttcaatccaaacatatctactgcccttcggttgataataatcagcaccatctgaagaagtgttccaaataggagagcttacatcaaaaccatgaagaccgggatttcgagcattgacgtttctaacccgaacaaatttagagttaacaatacccacacagtttgcatttgttccatttgtaatggtgttgtcctttttgtctaaattccaatcgaggtctaagtcttcaattaagatatattcatttccgtttgtgtagtcgctattggttaacacacaagatgttccggtagcagttgggtgaagcttgataatagatcctgatccaacaccgtaaagtctgacataagaagggacatgtaatccttgaaccatataaatacctgcgggtacaaaaacttctcgcttcccgctggaaaaagcagctttaaaagcttcagagtcatcagtaaccccgtcacccttagctccaaaatcctgaacattgacacttcgtctgataaattcatttaagactttatcaacaattgttgcaccggatgctgggatttttgaaatgtctccaatagtgtttgtgatatctgttaaaccagaatcgactgtgcttattacgtttttaatatccttagaagctttatcaaaagcctcttgaatatcgtctgcagtatatctgatattatttgattttaaccctatagtatcaatgggtatccattgctctgtttcttcgtccatataacccattgtgtttacgggaattaaattgtcgttcaatatatactcctccttatccttttctaatccaaaccatgcttccgtcagggggttctacagatggttttatcctcatctttttgggagcattgttcgttctcaaccatactgatctgatgttgtaaggctctacatagctagaaacaatgttgaaaccgtcatacttatctgagacgctaatatttatccagtcaaaaccatcccatcgatattcaattcctgtttcttttacagtgacagtccaaccaatttgaggggaaggataagtgtttaataaatcctgataggtgtacacaaacggcaagtaaatcttcctagtgttttcaactacatattcatagtctgatgttgcttgtctacaccaatttgttatttcaatacatcgcttggtgacacgttcacattcagcaatacgttcattgatacgaataatggcatcttcagcatcatcaattaagccttgaagcgtttcaatgaccatatttccttgtcgtttaatccaaattcttgaggcagggaagaaggatgcgccttctccttgatatgtaaaagtaagtgatttgccttcgtttgaaccattgaaaaagacaactcccataaggtaatcaaccttaaagtagttgtcttctaattcaccatcttcaatttctcgccattctttactgtcaccactaacctcgactctgtactcacggttaggcacttctgtaagtaagactcgaccattgtaaacagttaaagtttcactatagcttaaataagggtcattgattgagcccttccttttttgagaaagggtgggatcgttatagagctgaggaaaatccaaactaaattcaccgtcctttcttattgtgtaattgatttgagcaattcttctaagtgcgcgactctttcttctaagctctgtagtttgccttttgtaccgcctaatgtttgtcctctgataatggattcggctttcttgccaattacattgtacacagacttctcatctgaaattgcatatacagaatatccttgccaccaatcttgagcttgaaaaactctaacccatgcttcaaaccaattcgcctgaattgattcattgtattcccctaggtcaccgaatgcgttatggggctgttcaggagagttactgtaaggtgggatgccaagttcaccaaagaagatcggcttattccatttatcataaaatgctttgatttccttgaatatattctgtcctcgcccgtataacggtacgctataaatagcatcaattaactgatcgacagatggatttcgattatcagttaattcaaagtaagttgctattgcaataatatcgactagtccaaatataggattgttcagctttttgttatacgcggcaatcgtttcaggagaccactcagcggttacccaataatttgtccggtagagtatcttgccagaaaataaactccttaggcctgtaataactgatttccacttttctgttgagtcttccatatgaactaagtttgaagcaatgtataagccgtctaatttaaattgttcgcattttttagcgaagtcttgcaggatgctgttccatgctgcgaaccattggtctagatcagaaggtgcccaatcggtttcagctatcgttccatttgcgatgaaggggtagggttctaaaataatgttgtacccgtcatttttgagtttagggatcatatcccacgcttcgttataagtgtaatccacaacagttggatttgagtctgaagcatccactgcattaataaggataggaatagtgattgtatttaagtttaaaacagttgaatcataactgacatcggcatagtatttacggccaaatgctgaaacatttccgcctttccatttcaaggggttgaccaaaaggttattgagttcaatgttttgaacgcgactatcgtagtcggacagcttagtgtcaacttgtgctgctgtggtttcaactaattcagcagttttttgatcactggaaacccatttttcgccgtcgtaagatgaaacaacacctgtaaccgtattagtccataaatcgtttgcttctggttcctcaggctcggttgaggagaccgtgtatttcgagccatttagctttcctttaacttctacagtagaagaagggaggtaggggttttcgtttgggtgaagggattttacgatgtcagatccaatgaattgagttatctctatatctgcatcaactcttcgataggcttgaataccaattgtgtagtacatattggaggggagccctgtaaatgtagtagctcgtttgtcatactttacattcttcaagtcttcacttgccatttttgagccaaaaacgtactcttcatttttgttgcttccatgcagataaatttcaaaaccatcaatattgtattgatcttcgtctgattcaacatagtcccattggaaagttacatcaacagaaccatcatcattggtcgtatgagaaatagcagtgccgtcctttgcaataacaggggaggcgggtttaacagcaatcctgtcattacgtcggttgaagttttcagtaacctcatcgtacttgattttccttttgtttgtctcagtgctgattttatttgttcgataaactgttttcagcatgttctcaaaatccgatgaagcgcgtttaccatttgaaactgtaacgctcaagttagactgttcaaaatcaatcgaaatagctgttattgttgcttttacatcggtatagaagcttttctgttgcacccttacgatgtcgccaagagaaaacctgtcccagttatgtttttcactaatgcaattgaaaaagttcactaaacctaatgccagattaacagctggtgcatttcggttttcaagttcttcgtttgtagcgtcatataattcattctcatcaaagatactgtcattagaccattcggctgtaataatgtattttgaaagttctttttggagttcagtgctgaagttcttttcaaaagacagtttatctttaaggtcggtaatctgtgttgaaatttgtgtaatagaagcttgtattgctttaatttcttctttttttgattcaacttcttttgatttagcatctctttgctttattagatcagtagtatcatcgccggctttacttgcaactgtaatcctgtccaatatcttttggaaatcaagctgcaacgtatataggtcattattcgatgctgtttctttttcctcggctttctttttctcatctaaaagtttgtagaaagaactgccttcattattaaccaggtcgttgtaatctaaaattgcatgacaaagtgcatcagacatgtagttgcttctttcgattacatttcgtttctggtcacgctgaaaagggtagaggaagtacgaaaaatcgtctatgtatgattgtccggttggatttacggagttgatgcttaatccatctttgcctgtagcataaatccttgtaacgacatcatccatatcctcaatatcatccagagaaatcatatattgggcaggggttattttgagtcccttatatttagacacatcagattctttgtaaaaatcaactgtacagtcaattgtattaaaaacaggaatcgcttcgaatttctcgcaaatcgaatacataaaatcaagcttgtttgaagaagaaatatcaaactgtctgtattttaaattgaagaggggatcaatgaaaccgatagaccattcagtattttttaggcagtcggtagcggcctctttaagatttttcgaagtttcttcatacttaatgacaccttgcttagaaagtacatattgaagtgatttgcattcaacctggatagtgtccatatcattgctgtatgatttggttttcttgactactgtaaaccagattataagtccataaaattctgattttattaagtaccagggcctcaatagatcaacaacatgattccgtttatttacaccatcgtaagtggcagttaaagggattgagaatgttaattcgtgtacattgctgccgtgattgagcgttaccataggattgattacttcatcaatatttgcgatctttgttttatttggtttagctagggaaagacgaatatctttaatttccgtgtctttacgaattgtaatcaaatgtctaacccctcctacaaatacttgtatctaaatgaaaatcttaatttacaattgcctgtaacctttaatctgttccttccaaagcccaatctcaagtactggtcattaaaatcgtcatagcgctcattgccataaagattagactcaataatttctttttcgccgtttatttttaagagctctttatctttcaagttgctgaataaaaacggttcgctgaaatcactgagattttcgatttttatgtcaccatcaccaattttcaatatttctaaagaggggaagatgtttacatcgcctttattttgcaactcaacaatttcagtaccagaggatatatcaaatgcatgagtgattgcatttcgactgtaagcgtaaggggagttgcatttcatagttaaccggacgtagccattacgagcggcattatgaactaaatcagctgtatctactggcattgcataataaacgatatcaaggttttggctaaacgcaaaaggcttgtaatcatctacacttaaccaacgtttaattgctcgtacattcttttcatcaaagtgatcaccgagataaaaattcaatgggaattgcttaggttcctgtttaacaccttcagtgtagggctcaggccgcatctttacataagtctcattgactgttcttgagcctaagaacggttcctcaactaagcctgaatcagtattaacatttgtgacaccatagtcacttgatttttcgttattaaataaaaaatagaggctttctctaatcaatttttatcacctcaaaaataagaagagccagcatatacactggctcatgagttattgaaatttatgcccttgtttttaagaccatttgcaaatttattgaatacaaaatcagctgttttctgaggattttctgattcattaatgttaaatgtagctttaaaattattgttgtttacagtgccgtttactgacttagtagcatctggtggggaagagaggctttgaatactcggtatcaaactattagaaagactggattgattaatattcggaattattgatggaatagaagtaatccctttgttaatcaaggcatctaattttccactttgcccccatttaggtgtctcttcacttggagtattgttctcacgtacagcttttactgtatctaagatgtttgcagtatcagttttattaaggataagttctttatcatgaagaatagcaagcttgccagcacctaaacctgttcctgtgtatcctcctgtttcaaatgaagatatttttttgcctgttgtattgcctttggtcacagtattaagggcattagaagcttctttaagcttatcgataaggttattagagatacttttaccaatggactccatattgctgttaatgaatttagagaattcattcagttgcttagcaatatcagtaatcttcccatccattagctttttctcaagttccttaaatccacgctcatcattgacgagatcatcatatttcttgttaattgaatcttcgtctttttgaagctgatcttgcaacgcttcttttcgtttgctactttcacgatctttaagaaactcatctaaatctaactgttccttttgtagctgctcagtcaattccttaacctttgacttgccaaattctgagtcatcaagagaatactgattaatttggtcagtgagtttttggatactgtcttgcttctcttttaactgtttttgaaatttagcttcatcatcagttttatcaatctcatcaatcaagtcttgcgtagctttttgatgcgcttttaattcaatatcacgcatcttttcgtacatctctttgtagatggagacaacttcatcagcaagggatttgtacacatctttgattgatttctttgtgttgtaaagctccagattgtaatccttctgcttgtctttccagttctcgatttcttcagtaatttgtttctgaatatccgggaaccctttagcagctttcttttgtgcttccaactgtttgatatacttcttcgcttcattctgttgctgctgaataagcttaatctgttggctataaaatttaaccttgtctttatcttcctcggtcatggatattttgttgctaacatctttaagcttggattcagttttcttggttgatttctctataccgttaagggtttcatcaactttggattggatgagctgtccctgaagttctcttacttcttcttggaaattgatgagatcaatcttagcttgttttaattcctcagcaagctgtgctctttgagcggcattcagagttttgtttgttttgatttctttttcaataaaagaaaccttctgactctgaatcttttgctgttcagttaaagcttttttctgatcgtttgtatacttgcggaattctttactgtcgctcaggtaatgactagcgagcgctttgtctttagcgattcttacgtcaaaatcgccaatacgcttgtcatattcatcgagtttcgattgaacgatctcatatctgagctcttgtatctgatcgtttactgaatcaatgtcaccttggagagagaggaggtctgatttagcttgtgcgattgcttgttgtcgttctgcttcggcttgggatgcatctgaaatagatgtaccgacaccttttaaatacttctcagggtcaattgtctttccgttttcctcaatttgaagatgaaggtgatttccagttgaattacccgtactgccaactttaccaatggtctggccagctttaacagtttgaccggctttaacagaaggggtatcaagcatatgcatatacttagcaacttttccatcatcctgttgaatgacaacccagttaccggcagttttactatagccagcaatttgaacttttccactctgaaccgatttaattgcggttccagcttttgctgcgaagtcgatacctttatgcggagttgaacggtaagcgccatcttgtgcgccatatttagaacttattctaaacgcactgttcttcgtgtagtagcttgcaatggaggaattagcagaagtcattgacttcgtgtaattcgacatgatcttctgaacataattctgtgtttctttgaagggagggacgccgccgtatttaattacattaccaggccctgcattataagcagcaagtgctttctcaacattaccaccaaatttgcttagttgttgggctaaatatttcgtgccacccataatgctctgataaggatcataaacattgtttacgcctaagcttttagcagtggatggcatcaactgcatcaaaccagcagctcctgctccagaacgagctcttgcattgaatcctgattcttgctggattacagctgcaattagagctggatcaacaccatatttgctagcggcagaatttatgtagctggagtatttaccggagtaagacccgccaccggaagaataagaaccaccagaagatgaaccagaggagagggaagaggtaacaataccgtactgtgcaatgttccctgacttgatttgatccttgaggagtttggcttgctcctgcataagctttttcttttgttgaagagctttaatttctttctgcagggcatttcgataactttgagaatactttggatagtcatttacctgcttattgtacttttcaacttcagcgttgactttctccagagcttccttgtatttatcagccacatacatagatgttttaatttcctcagaggctttatcacttgaagaagacaggtcatcaagagatgttcctgtttcagatagggaagttgaagccaaatctgctagtttatcaagctctttaagctgatcggtgatatcagtgacctggtttaaatcaccctgtgttttcggtaggaactggagcgcaccactgttccctttttttagttcgtcgtatatctttttcttgttgtcttcaagctcagacttcattttataagcgtcttgaacagtcttaatagccttgacttcagacttatacatattaatctttttatttaatgcattagcctgattaattagatcttgtctaacagattgttgcatatcattgtaagctttgagttttgtgtcccgaagcttaacaactgcatttctgttgatttttacaacaccattttcaactgaaattgcatcagcaagatcatgttctttctgaataagcttcatggcttctgtagcagatatgcttttaccttcagacattttttcaaggaggttatttaaaggggagatgctgtcagacatagtgtcataagcttcattttgaatggcagatatagcagcatcattttgctttgattcaactaagtcatcgatgattcctttaattgcttcaaaatcacctttagcttctttgagcttgtcagataaattcccgacttgctcacctaatgcatctacaccttcaccattttcatcccaagttacttttgcagtttttgctgaatcatttgtagagtctatggcttcttttaaattgtcataagagagaaccaagccattattcttgttttcaccagtcatgtattgattgacgagttcttccaggctcttagaagcggaagcaaatccgtctttatcaccagagttcagtgctttttgtattcttaccaagtcgtcagaaactgttttagaaaaggaggttagttcatcagcactaagcttagtaaaatcaattttgctaaatgcatcgttaatatctttctttatatttgggtcaatttttattgagttataagcgtcaactgttttctgaacttgttcccttatttcaatttgaacaccagatagactttgacccagccttttggcttcttgttctgccttaacacctgcatttttgtaatcatcatcactagagaaaggattctccaggaaagaccaaacagatttaccttttgagtacgtatttgccattttctcgtactgattgatctgttctcttaatttgtcaaattctttgagctggtctttgaaatcacttttagtacttgttttgatatcttctttgtttaatttggctaagtcttcggtgtacttaatggcatcctttaatgcctcattgtttttaataatagcattgccctgagaatcataaccagaaaccaacataggaaatgtttgtgctaattgttgtgttacttgtagatattcttgttctttttcaggtgataaagaacctgcttccttagctttttgaaggtcttgatattgacttattagtttgtcagtttcatctttattcgttgtaattgcttcaatacttgtagactttgattgctcaaaatcctctttagcttgttttagttttgaataagatgatataagtttttcaattactaccccaagaccaaccattgcagccattggaagaaaactgcccgctaagaatgctccagtagtcattgctacttttttaagcccggctagagacgtactaaacgcagttacaattctattccaaataactgttttggcagacgcagtagtcacacctacagttacagcattaaagttgagcgctaaattcttaagagtggctcccattgccattcctgaagtaagtgcacttgtacgaagggaagtgttgaaaagcataactgcagctgtagcggctcctacaacttgaggaagaagtccaactgatttagttatttgggcacttatttgcattaaacctttaagcgcatctgcaaaaacaacaatgctatctgatatgaaagcttcacttgaggcaaccgacatttctgtaaatgcatttgacaacctgtttaatcttgcctgtaagctgtctgcatatttctgttgctcgctccatgcactcccagcggaattagcggcagtcgttgcggcattctgggcaatagagaaattattcatcattgcattaaatcttgaaagctgataaataccggctacgcctattgaggtattttgcttttgagcatcactcagagtgtcccatttttctgcaacttcgccgataaggtcacttgctgacttagcttctccacccgcagtctttacagaaattccgatctgttctaaggctttaattgagctatcattgtttccaattcgtgcgaaaatcgtctttaatgagttaccaacaatgtttcctgattcacgagtggtacttccaattgctgtagtgtatccaattaaatcatttaattcaacaccaaaagtagaagcagtacttcctgcttttcgaattgagttggctagatcaagagtggttacagcgtagttgttatctacttcatttagcttatctgcgactgaaatagaatcattagctgcaatattgaagttcaacattgcggcagttaaagtgttaactgtgtcatcaggagttaaatcagagacgttttgtaaaacctgagcggtttttgttagagtggacaattcactttcatcgaagcccatacgcccgaaatcaccggtcatttgaagaatgtcagtgattttgtttgaaagggtgtcacctaaatctattgattcctgaagtagctcattgtacttataatcaggctcattcattacacgtctgatgttggtcatcaaagtgtcaatttcaacagcttgagataccatttctttgagcccagatatagcaccatagaacaaagaaccggagattaaatatgtagacatacttttgaaagcttgcgttagctccgcaccaaaagacgaggcttgactagacgctgtttgagcatttgaagctaattccctgaattgcatgttcaagctttgcatttgagatctgacattgtttccgccggcacttacgttaagactattaaccgcattcagatattcttgaatagcttgtctatttccggagcctatcgtatctccgtagcgagtattaaggttttgtacgtttacttgtgcttggcgttgatacaactcaatagtttttctgagttcattatttttcgccaccgcagcagacttatcatcgagcatcttaattctgttttgtaatgcttcaatttgttgtgctgtttgaacagtatttaatttccgtccaagggaagagagggtggtgtcagttacaattccttgctgtctaagtttttctaaatccagttttaattgttcaatagcttttcgttgctgatcatagttcgttgttactttagatgtagtagcgtttgtttttggatcagttgtataggtaatatcgtcaaagccattgcggttcttttgagtaaccctcgtcgtttgtccttgagcattcttttgttctgttttcttctgtacctgaccaagtttttcagtcgcttgagcaagtctgttaacttcttgtgtttgttcacgtagtgattgattacgattgtctatggtctttgtttcacgctgaatgatttcgccatttttcttatactgctgagtaagcttttcaacagtaccatcagcatttcttgtaatcgttgtggtttctttaactgtttgattgaaggatttgaggtgtttttgataagtttcaactgcagaggagaagtcgttgagagtctttaaagcagaggcatcaatattggtctttaaattaagggaattaagctttttctctaaagatttaatttgctgatttaactgttcgacagtttttgaagaagtatcagctttgggtgtgagtatgatctttaaatcttgactcaaatatagttcacatcctttcgagtaggggagagtgatttttagggcatataaaaaagccactcattattgagcgactttgtttgctttccgaattgctatctccataatcccttgccatacttcagcatttgataaagcatctttaacttttggatcattctgtgtaaaccctttaagattctctaggccaaaatcatccttactcggtaggaaatcaaatctgtaaataggggaggagaaatcatcgagctttaatttcaaatcaattttcttgaagaatttagtttctgtcttattagaggatagcccgccaactaaagctccaacacttcctgcagctagtccaccaacaacagcacctgttatttggcttcctttggacactttagtaactgtactatcatcaattgaaacctcggcttcaataattttttcaaagggtataattttttcttccagtgttccactttgattgaacatatggattacaaacttatcttctggctcaaccaatgtaagttttgttgttttatctggatttaaaatagccttgtactgagcagggaaattcccggcagtttcaatttcaaataacttttttttctcaatttctttctgtttatctgttccaaagtctccaattataaaaaaagcagcaatgatcaacaaaacaattattgcccagatcatccaaccaccaccagtattattttcctacattatatcatgatttccaaaaggttagaaccaactaaggggagggtcactttcctttttcagacttaatctgctcaagtaattctttaaagtatgtagcagtaataacaatgtccctatcctttcgtacaacgaaaagtaggagaaggcaaagggatgttgcgattagaatataccaaagcaaattaaacctaaacaaaattctgagagatagtaagcatgttcctatgagcacacttccaactgtccacatttttgtatgatcgaaggacgcttcaattcgagtcatacgggaaatagctaagattaaatctgatgaattaagcgattttaggatttgaaatttgcgcttttgttctgtgtacggctcaccagagtgcgggaattctttttgtatgtatttgatcaggtcgcgactgtccatctgtactaaattatgcttaagtattgtcttattcatatttttcacctctccatattatcgtcaaatatggaaatatgtttaaggttttatccataagcaaaatccctcaattgaaggattttgattctgcataaaagagtgatttcataaagagtgctacctaaagcaaatcaattgatatgtctcccaacaggcttttcttaatctttccgtattcaactttaccatcactgatcttggattcatcaatctgtttagatccgaattggttcttatcagctttagcatcaagctgcctagttaattcagcaacagcttcgttcaatttattaatttgctgttgcatattctcaattgaactttggtgaggattgaagaggctcataatgtttacgagaagatttgattcttttcttctttaaaatcacgaaggtcgtaatgcttaattgttgtagacacatcattatgctgtgcaacatatttactcacgagctcaatcttaattttcttgacttcaagaaggtaagtaatacaggaggctttaaagaggtgagggttaatgcggcggccaaggatatcagaaagaacatcagaacaaaaatagtcagcccaaccctctgacatttgtcttggttgaccaccgtactgtgtggtaaatagatattcatggtcatatccccgctgttcatgccaaagcttcaaatattccagagcttctgtgttaatcatgtagtcgagaggttttccttcgccctttccttttccaagaactttgtgagccatgacataagattgaccttcaggtatctcataattcaggatttcggttttaaactgaattatttcagctcttctggcacctacattaaaggcagtagctaaccaagccatccccaaatagtttttgtcttcttcaagcactttcatcattgttctgtattcatcgtaagtaacctttactttttcatacgtggttgttttagggatggcagggagacctcttgtgaagttcctgaatgatttgtaattatcgtcatcttcagcaacaacattttcaatgtagttatttaaagaagatactccagccttttttaaagctattccacttgaagacatccctctatttttcaggaagctttgatatctgatgaaatcccttttggatattttgtaaagcttcttcccattcaaggaattatgtacccaccagaagaactgacgaagagaggagttgtattgcttccttgttttatctcggaatgagtgggcgtcaagaaactcttgagttaagcttctatgctcgtcatcaacctgaccccacatttcatccgtgacttcgggcaacttttcggctctagagcgcatcatgttttgttttatttctctggccattaatacaccaccgttattctgttttaataccacttgcatttaaatcttttttcatagcagcagctaatcgtccatcttttaacgattcagcggtattcttcataaatgggcgaggttttccataaccataaccgtatttatctggatacgtgtacccttgaccagtctcaacaaccgtggcaacatccttactgttgtcttcacgggtattgtctaatgaaattccgttagattcgttttgaatgacaaaggagtccttcaaaagagttgtacgttcatattcaaggggatcgtaggcgtcatatacatcagattgtacatgctcttgacccgttttaatcatcgtattttttgtgctggattgtttttgaacggcttgctttgcggcaaattcaattagtgctgctatttcttttatgttcttggccattattcagcctcttgttcattttcaacctcttcgaccttattaaggatgagatcatttatttcttcaggagatatgtttgaaagcttgtctaaattctcttgcatcatctttgttgcttctccaaatttcttcatgctttcttcagggaagctactaataatcaatgggaaaaattcagagtccacaagcttaacaaaccacttaactttgtttttgatatcacttggaatacccaagtctgtaaattctttaattagtgaaaagaatccccattgaacaggatttatgcttttaaagtcaatgtttttttcttgagcattttgtggatccgtaattaattcagtaagcattttggttaagcgggtaggggagaagtacgggtaaataaaaacatgaacgtcatcagttagttgaactcgttctttcttgtcatatttacttacactttcttcgattaacccaagatttaattttttcgatgccatttcaattcctcctcatatatcctctgcacacattaaaaaagacacctcaaaaggggagaggtgtctaaataaaacttgtattttatttataatcttcttttagaactttctctgtataagctgggttatttgtaaatagtccatccactttcaacttaagcattttggatgtgagtgctctttctttatcagcgttaaaaaacacatgtactttcatattgtttttgtggactaaatcaacaaaacctttatcaacaaattttgcattagggccaacaacattagaataattttttatttcgtttagctttgatttgctcatcggcttaatgtcttcatctttcaaaagttgaacaagaggaacatcattgtttagcttatgtaacttctttagacttttgtcactaaatgactctaaaacaactttgttattagcgattagtttatttttagagagtatgtcaattaactttttctccattaccaatttgcctttgttgtttgttctagtctcgatataatactttgttgtttgtccaaacttcttaatgatttcttcaatcgttaagatcttttgtccttttctagtatgtagctttttaatctggtctaatgtaagatcttcaacttctcctttaccgtttgtggttcgatcaacagtcttgtcatggtttgcgactaggtgaccgtctttggtttgtcgtaaatcaatttcaatgtagtctgctttgtcttttattgctcgttcataggagagtagggtatgttctggctcaatttccgaggcgcctctgtgtgcaatcattagcggctcgtattttttactgcttcctttcccataacctaaagctgatgaatcaacttcgttaaatgaacatcctcctagtatggctaaagcaatagttaatgttatcaattttatttttttcatgacctaaaattatcataattaggtagttggttcaatatatttctttccaacaatttcttcgtactgttctggtgtaatttttccttttactacagcttgcgctactcgatattcatcccacacaccattgccgtcgttgtaataatcttttataagttcataccaattcatttaaagtacaccatccatcattagttgatatgttaagtcacttaattgttttttaaccttttcagcttccgatggctcggggacaagtggttttaagctgtcaatgtattctttcgatgctgactcaatccatttttttgttttaggattgaatttgggaatataaagaccatcggatggagctattatagtgcaattatcaggaattggactatcgtcttcaagcacaacaggggattcataaatataattttcgtcatatttgtatacttgcatcataatattctccctacacggccttaaaactaaagccgaaactaatgtaatcattgggtttggaggtatttgtacaactttctataataactcttccttcagtatcaacaagcgttctgtgagtctggggtattcctgacattcctgcttgggaagctacacccacccattgaaacgctcttccgggtctgtatccttcaggcaaagtgaatgctgccactccaaaaccaatcgttccttttgctatagctccctctacaaaaacagtccccgttgcatcctttgtataccgagttttaaacactgtttggtctgttgagttaacatctgtgtaattaacccatccattctgtaaagtaggagtgtaccatgtcattgaagaaaccttggtatcagtataagttttagctgagttgagtgcagcagtagctcttgtttgtgctccgtcggttgtttcatgtgtttgccatgaagtccaagttgaatcactctttctaaatcggaaataagtatgagttccgtaatatgcttctaaagcaaattgggctattgtatcaccataattcatgacaaccaaatatacattgggcaagttagcaggggagtgtagcccctggttggcgattaaatagaacccggtggtaatcaaatcgttgtattccgttttttcagaactgtctttgtagattacttttccatcatcggcagtgagtttgaaaagttgagcagcgttccatttatcccgatcagatttgttgatatggacattagtgtcatttagatgattgtcaaagtcatttttagtagcttgttttacattgtctacattcccgagcccaacctgttcagcagtaaccttgtgtgggtttgattgatcgttagtatgttcagctaaaaaagactttgacctttcatcggagctgttccaataactgcgctcatcctttgtgatatgtcgatccaggtctgcatcatgagcgtcaaaatccaccttcgatgcctgttggatattatcaaccttagacaaaccaacttggcttttagtaactgcatgagggtttttcttgtcgtcaagatgtccatcaaaatccacctttgtggcttgctcttcattaagtacatttgataatccgacttgctctttagttacatggtgagggttttcaatgttcagagtgtgcgactttaattctgaattttgcttttccatgaactcatcgaccttatcggataaacgtttttcatgatcagacatgtgagattcagttctgaaaaattgatctttaaggttattgatttgtacattgttttgtttgagctgacctacaaatttactgctactcattaactcaccgcgattcctttaaccgtaacatctccatttacggaaatgacctcaaccatgaatttgaaaagccccgcaatatcgaaatcccagttttcatttgtattcaatgtgcccgtacctaattgaaaatcagttttgtttgttccagcaatttctgtcttttcaccattttcatctacggcaaagaattttatttctcttgaagttgaggaaccagagatcttaacagtaatatcccgataatgtgatactacaaattcttcaccttcagacggggcagttgttgcttcgtggaatgtaaaggttgctttatctggaatggtttttaaaatattttcatcggtttctgtcaacaactccacctcctaaatctgtttaaaaactgacttttatttaaaaaggagaggggaagaatcccctcaaattatttagcttcaaacactcttacatctctgtcagtaccgtcattaatcacatagacataaagtgttttgccagcagcaacaggcaccgaaaaaggtttgtcgccggcggtcaatgggatacctgtatcagcagtcacagtagagtttccaatgtaaatcgtgccttctgcaggaggataaatagtaagggctaaagaaaaataattagcacatgaaaaaggagatttctattttagaactcctttttcatattagaaggtgcctatgtcagtattgattcagaaatactcatagaataaaaaaacccatctttaaagatgagcgtaaacgtagaagtatgtacatttcagttatgaaccatgtcgagaaaatgatcaatcacaatagaggacattcctaaagcgggtgcattttttcctaggatagatggtaataattcatagctattgtctaaatgggaataaaccctggatgacacttcacttttaattgaatgtaaaaccataggatgcgattcaatgatgctgtttcttaaaatgatggcttgcggattaaatgtatttagaatattggtcaggcctattcctaaatagaaaccaaaattttgtaatgcctgtaaagttccaacatcattcagatgggcgaggtctatgatatcttggctggacacttttttctctttcgtctgaagagatgttaataaagccttctctgaagcatacaattcccagcagcctcggtttccgcagctgcatttaggacccttaaagtctattgtcatatgtcccatttctccagagaatccgccaacccctctatataaatgattgttgattataacgccgatccctattcctgtaccgatacttgcataaatcatgttatcgtgattttttgcagctccaaatactttctctccatatgcgccggcatttgcctcattttcaataaaaacgggcacattgaacttctctcggatgaaagattttaagtcaatatctctccagttggagttcggagtgaaaacaattttttgatttttgtcaatcagcccgggcacgcaaatacctataccaataagcccgtacggagattgggacatatgcgtaataaagtgatgaatcatctcaattaaaatatctttagtgatttctggagaattgcattccaaacgatggtgttgatcaaggacgatcgtcccttcaagatctgttaaaatgccattaacataatccacgccaacatctattcctacggagtatcctgcttttttattaaaaacaagcatgacaggtcttctgccgccgctggattgtccctgacctatttcaaatacgaggttttctttcattaatgtgtttacctgtgacgaaacagttgatttatttaatccggtcatttcagataattttgctcttgaaataggagaattcttaagtatttcgtttagtaataacttttggttaacttttttgacaaaggcttgatcagcgatatccacttcatccactccatttgtataatctttaaattaagttgaacgttctgtgttatcgtgcgaaacgcagtacatagcgaatccaacctttattatatctaatgtgttcgtaaaaaactaaaaaaaatattgaaaatactgatgaggttatataagatgaaaataagttagtttgtttaggcaacaaactaaagtataacatgacataaaagcatttgtatttgaatgatcatgtttagaatttatttttaagggggaaatcacacatggctcactctcattccggttcagtcaactattttgaaagcgtaaacaaagtgatttacgaagggaaagaatccacgaatcctttagcatttaaatactataattctcaagaagtaattggcggaaaaacgatgaaagagcatttgcgattttctattgcctattggcatacatttaccgctgacggaacagacatttttggcgcagctacgatgcagagaccgtgggatcactataaaggcatggatctggcgagagcgagggtagatgcagcgtttgagctgtttgaaaaactggatgcgccattttttgcttttcatgaccgggatatcgcacctgaaggaagtacgttaaaagagacaaatcaaaatctggatataatcgtggacatgataaaagactacatgagaaccagcggcgttaagttattatggaatactgcaaacatgtttacgaatccccgtttcgtccatggtgcggcgacttcttgtaatgcagatgtatttgcgtatgccgcagcccaagtaaaaaaaggattagaaacagcaaaagagcttggcgcggagaactatgtattttggggcggacgtgaagggtacgaaactttgttaaataccgatttaaaatttgagcttgataatatggccagatttatgcatatggcagtggattatgcgaaggaaatcgggtatacagggcagtttttgattgaaccaaaaccaaaagagccgaccacccatcaatatgatacggacgcagcaacaaccattgcctttttaaagcaatatggcttagacaatcattttaaattaaatctcgaagccaaccatgccacattagccgggcatacattcgaacatgaattacgcatggcgagagtgcatggtctgcttggctctgttgacgcgaatcagggtgatccccttttaggctgggacacagatgaatttccgacagatttatattctgcgacattagcaatgtacgaaatcctgcaaaatggcggtcttggaagcggcggattaaactttgacgcaaaggtcagaagatcttcttttgagcctgatgatttactatatgcccatgttgcagggatggatacatttgcaagagggttgaaagccgcccacaaattaatcgaagatcgtgtgtttgaagatgtgattcaacaccgttaccgcagttttactgaagggattggtcttgaaattgcagaaggaagagctgattttaagacacttgagcaatatgcgctgaacaatcagccaattaaaaacgaatcagggagacaggagcggttaaaagcgatattaaaccaatacattttacaggtataatgaaaaaagaagctccagatcccgctgtaaaaagatgcaggcagccaagttcccggaattgcccgtcatgaagttactgttatggcgggtcatttcaatggggatctatttagagaggaaggagtgaaaaaatgaagtatgtcattggaatagatcttggaacgagtgccgttaaaaccattttagtcaatcaaaacggcaaggtttgtgcagaaacgtccaaaagttacccgctcatccaagagaaggcgggatatagtgagcaaaatcctgaagactgggtgcagcaaacaattgaagcattggctgaattgatttcgatatccaacgttcaagccggggatattgacgggataagctattcgggacaaatgcatgggttagtactgcttgaccaagatcggcgggtgctgcgtcatgcgattctttggaatgataccagaacgacgcctcaatgtagcaggataaccgagacatttggcgatcatctgcttgatatcacaaaaaaccgtgtccttgaagggtttacattacctaaaatgttatgggtgaaggaacatgagccagaactttttcacaaaaccgctgtttttttgcttccgaaagactatgtgagattccgcatgactggcgccattcacaccgaatactccgatgcggcgggaacgttacttttacatatgacccgcaaagagtggagcgatgagatttgcaatcaatttggtatttcggcggaaatttgtcctccgcttgttgaatcccatgactgtgtaggatcgctgcttccgagcgttgcggcgaagacagggctgttggaaaaaacaaaagtgtacgccgggggagcagataatgcttgcggtgctgtcggagccggtattctttcttccggaaaaacgttatgcagcattgggacgtcaggagtcatactttcctgtgaggaagacaaagaaagagattttaaagggaaagtgcacttttttaatcatggaaaaaaggattctttttatacgatgggggtcacgctcgctgcagggtacagcttggactggtttaaaaaaacgtttgcgccaaacgaatcgtttgaacaattattgcggggagtggaatctgttccgataggagcaaatggactgctgtacactccttacttagtcggtgaaagaacgccgcatgctgattcttctattcggggaagcttgatcggaatggacggagcccacaaaagagagcactttttgagggcgataatggaaggcatcacattctctttatatgaatcaattgagctattccgcgaagcgggaaaatcagttgatacggttgtctctattggcgggggggctaaaaatgaaacgtggcttcaaatgcaagctgatattttcaatacgagggtggttaagttagagaatgaacaaggtcccgccatgggggctgcgatgttagctgccttcggaagcgggtggtttgactctcttgaagaatgtgcagagcagttcattcatgaagcagctgcattttatccaaaagaacaaaatgttcaaaaatataaaacactattcgagttgtataagaacatttacgttcacacaaaagatctcaatacagctttaaagagctttagacaaaaatgaagaaagaacctcgccaaattggccaggttctttttatattgcacaaaaacagacacggtgatataatcagaacacgcgtgctttttgtgtgaaaagtcatagttatccatcttatattatgattatatcatgctgaaaagctcttgtcaaatttttttgaaggggagatatagaatgagttctttggttctcggcattcacgaaattgaaaaaacacagcctttgctcgttggaggaaaagggttacatttaggggaattatcaaaaattcaaggaatacaagtaccggaaggattttgtgtcacaaccgcaggatatcaaaaagccattgaacaaaatgaaacattacaagcgctgttggatcaactgaccatgctgaaagtggagaatcgggatcaaattggtgaagtcagcaaaaaaatccggcaaaccattatggaaacagaaattccttcagatgtagtcaaagcagttgcttgccatctctcccggttcggcgaagaacatgcctatgccgtacgttccagtgcgacagctgaggatttaccgcatgcctcttttgccggtcaacaagacacctatttaaatattaccggcgtcgatgcgatcttgaagcatatcagtaaatgttgggcgtctctatttacggatcgcgcggtcatttaccgtatgcaaaatggatttgatcacagccaagtttatttatccgttatcatccaaaggatggtgttccctcaggcttcgggaattttatttaccgctgatccgataaccggaaaccgaaagctgctatccatcgatgccggttttggacttggtgaagcacttgtctccggcttagtctctgccgattgttataaagtacaggacgggcaaatcgtcgataagagaatagaaactaaaaaattggctatctatggacgaaaagaaggcggaacagaaacacaggagatcgctcttgatcagcaaaagattcaaacactgactgatgaacaaattttacagctggcacgtatcgggagacagatcgaagctcatttcggccagccgcaagatatcgaatggtgtttggaccgcgatactttttatattgttcaaagtcgtccgatcacaacgttataccccgttcctgaagcgaacgatcaagaaaatcacgtctatatctctgttggtcatcagcaaatgatgacggatcccataaaaccccttggattgtctttttttctgttgacgactgctgcacccatgcgtaaagccggcggaaggctattcgttgatgtcacacatcaactggcatctcctaatgtcagagaagttttcttaaaaggcatggggcagcacgatccgctcttaaaagacgcacttatgaccataatagagcgagatgatttcattaagccgatacctgataaaacggcaccgattcccggcaaaggcaatgcagatatgccggaacaagctgaaaacgatccggcaattgtttctgatttgattaagagcagtcaggcatcgatagaagagttaaaacaaaacatccagacgaaatcaggatctgatttatttcgttttattttggaagatatccaggaattaaagaagattctatttaacccgaaaagttcggtgttgattcgaactgcaatggatgcttcatcatggattaacgaaaaaatgaacgagtggttaggtgaaaaaaacgcagcagatacgctttctcaatctgtaccccataatattacctcagaaatggggcttgcgctattggacgtcgccgatgtgatccgcccttatccagaagtaattgcctatttagagaatgtaaaagatgatcactttttggatgggctggtgacgtttgaaggcgggcgggaaacccgtgacgctatctatgcttatctcagcaagtacggaatgcgatgtgccggagaaattgatatgacaagaactcgatggagcgaaaaaccaactgcacttgtccctatgattcttaataatctcaaaaactttgagccaaatgccagccagcggaaatttgagcaagggcggcaggaggcgttgaagaaagaacaagagttattagaccgattgaagcaattaccgggtggtgaacaaaaagccaaagaaaccaaacgaatgatccgcatcatccggaacttcagcgggttcagagaatatccaaaatacggcatgatcagccgctacttcgtttataagcaggctttattgaaagaagccgaacaactcgcagaagcgggcgttattcatgaaaaagaagacatatactatctcacttttgaagaacttcaggaagtcgtacgctcaaataaattggattaccaaatcatcagcacacgaaaaggcgagtaccaagtatatgaaaaactagctccgccgcgtgttatcacgtctgacggtgaaatcgttacaggcgagtacaaacgagaaaatctcccctccggagcgattgcagggctgcccgtttcctcgggagtcatagaggggcgggcacgggttattttaaacatggaagatgccgatttggaagatggagatatattagttacctcctatactgatcccagctggacgccattgtttgtatccataaaaggcctggtcactgaagttggcggactgatgacccatggagcggttatcgcgcgtgaatacggcttacctgcagttgttggtgttgaaaatgcaacccaattgataaaagatgggcagcgaatccgcgttcatggaacagaaggctctattgaaatattataatagcgggggtgtgcagcacgtcaccagatatttcctgcattttactaagaaaagccggaacctcttagaggaggaatccggctttttttatgtgaaagccattttgcttaacaattatttatatgaatggtagcgttttattaaagagagaaggtgatttatgagatggtctgtttgatatgtagtattggtgccggatgacaattatttttttacaaaggggttattttcatgaacaagtcttgtgttaaagatgagacaagtctggtgtctttgagacagaaaagtctgcagaagataaaacgggctcatcatcaaacatgatgagtgctaagggttggactggatgtgtatcagattgtttatgcgataagaatattagccaatgggcaatcactggtttaactattttatgtggaactgcttgctatgcttgtataaatactgcaggtattattggtgtcaatgcaagctttgattgggagaaatgtaaatgattaatattttaagtaagatactatttattttgtctggttgcgcattgttgatctttgggatcattttaaagaatggatcaatggcttttggattgttcgccttaatattcatagcggcaatattagtccgagtatttcataaaagatctgaaaaggattagcagccgtaggcaggggaagaaactctcctgcttatgaaaaaacttcagagtaaaaataaaatgtttattttaaatggatttgttttcaaaagtaaaaacgccataaaacttcttatggcgtctgtccgaactaagggatgcaatgtttgggagacgaatatgaatcgtcaatgtgctaaaaaaggaatgcagcacctacaatgattaacaaaatgaatagtacaacgatcaatacgaaagagtttccgccataatttccaccgtaattcccaccgtagtatcccatattgccacctcctgttgttaggatatacataatatgccggacggtaaatttcgacatagatttaagtctaaataagaaaaaatggatgttatgtctaaaatgaagagcttctaagacaataaaataatgggaggttaactgaaagagagaaatggatgggacggtttgctgtttaaagaggagggatatggctaaacatgcaataaaactgtgtatgaaagtggctctgcatgaagttacttcatcatgcagagccacatacgaagagattcagggaaattatagttaacgaaaatattcatcatttcccgggcaagcgcagtatacgacaaatcaaaacaaatcacaaagggacggaaggtacgatacaaggagcctgcttgcgggtttgtggtgccgataaagtttccatttcaaaaaggtcatatgtttattcgacactttacgtttattcctgcagaatgcttgtaaaagaaagtcggcaaaactgccaactttcctaacggaatttagatctcaacagatctaaagaaaccatcgacactatcaccggtgccgctatcatatttcaggatgtattctcctttttggttaacgctgaattcttgaatgaacgttttccccgcatttaatgtcgtagaggataagagtgtattcccattaggataattaatggtgaatttgaaagatttgctgccgtcattcgcaacaaaaactctgatttttcctggagagctgccttgatagttgaatgaaaccttaccggtaccgccagaaaaaggctgacacgcaatatacggagcgtcacatgaccaaccagcaggtttcatgattttatcttgatttggcgaaggttttgcagaaacatctgcagtccccattaatggaattaacccaaaagcaagagcgccggcaataattttctggggcaaggagtatttctttaacgtgaaacttttataaagcattaacgtattactttataaaggtaaataaggaggcttctgaatgggattaaaaaatttctttaatactgagttaaaatgctctatctgcggaaaaacattaaaatcaggggatgagataacagcttatcttacacttccgagtgagaagaagatgcctgtggggagaatggacaaagtgttaagcaaacactctgataaggtctgctgtaaaaagtgcagtgagtaggtttttagtgttatgaggaacctctggcgggtttcctcataacaaatatcaaccaattaaattagaaaaaagcgaaattgtgatgattaaagtagataaagaactgagggataccaaagggatcatttttcgtttactttgcttttttgaaggtttgtttagctcgtggatcactgcaccccataaaagcatggatgctaaaatgataagactcatatgtaacaacgctcctttgtttttataaattttaccatatataacacaaggatgtcgattgaccgaacatctctataaaaagaagatgtttatctaaaattgttgagagattcagtgaactattatgtagattaaattgggcgtcaaattactcagtgaagatgaagctgtatacataagcaaaggttcaacaggcgttttattgaatatcagatgaagcaatagaagggtttatcggtgtcgcaaagtataaagcatatggtaattcgcgtattatgcggttaggtgaaaaaattaagctttctgcgtggtatcttgaagtgacaggaggtgagcggcataaatgtgtcagagcaaaaagagcacttccaattctaataaggaaaggaattgagaattgaaattagaacgtttgttatcaatcatattcaagctcttacataatgaaattttatctgcttccagtttagctgatgaatttcaagtatcaacgcggacagtttatagagacatcgaagcgatttgtgcagctggaataccagtcgtttcataccaaggggctaacggcggttttgggataatgagaggatacaaatttgataaaagtttaatcggttctcatgatgtattgaatttaattacagtattaagcagtttgtcgagtgtttttgaagataaggaagttgaacacacgatagatagattaaaatctctggatacaagcgaaagcagcaggactttgtatgttaacttggaaagccttagaacagaaccgaattcattaatccggctgcgaaaagctatacaggaaaaaaaggcagtacgctttgattatgtcagtaataaaaatgaatttacatcacgtgaagtagaacctatccaccttcagtataagtttcgtagttggtatgtatatggcttctgcagagaacgtcaagatgatagagaatttagagtatcacgtatgatgaatataacgcttactcaagaagagtttttgcgcagtcacaaagtgaaagatgaaccatcttattcagaatccgacctgggagggtttgcggatgtagtcatttgggttaatcctaattccatagctaaagtattagatcaatttcagaacgcttcaaaagtcatgaacagagatggaagtatgacgtttacaatctctgtgtatcggcctcagcatgccggatggcttaaatcaattcttttgagctttggcagtggcgctaaaattataaaaccggtggaacttcaatcaattttaatggatgaagctgaaaaaataatgaaaatttataaagatgtatgacaatctgctgtcatatatctttttttataatcacaagtatcaactttaaaggagagatgttaaatgaaccatgcgaaaaatatgtatcagtaccatgtttgggcgaataaagcgttattagaaagaataaaggaattaccaaatgacgtcatgcataaagaggttcacagttcatatcctacaattgttcaaacgttcagtcacatttgcgcggtggatgttatgtggctgcaagtacttaaaggaatagacatgcaggaagcattggaaggttctatggcttatgcagaaagggctcatttatattctgcagatgaatttgcggcgtcttatgaagaactggcttcacagtttgaagaatggatgaatagccaaacagatttagaacaaaaaatgaacttaaataatccttggttaggttacagagaaactgcttactcagaaattttattccatgttgccaatcacggaacttatcatcggggcagcataacaactatgttaagacagcagggctacgcttcggcaatgaatgaccttgcattatattggtatcagggttagttcaggcagtactcgcaaaatgaatgtccgctgaatggtctgtagagcttcttatctgaactaaatgacaaagtctcattcagtctgggtggggcgctgagcaagaatcgagatcaaaggctgccgtatcattcccggcagccttaatgattaggaagtaaaatcgataaccatgcggccggtcactttaccttgctccatttcttcaaaaatatcattcacatcttcgatcgggcgctttgtcactttaggtacaactttaccgtctgcggcaaattgaaaagcttccttcaaatcttctctggtacctactaatgaacctactacctgaatcccatctaacacgagacggggaatatctaaatccattttgtccaccggtaaaccgacagcgactacacgggctcctgcttttacaacatcaatcgcttgattgaaaggggttttagagacagccgtgatgaccacagcatcaagccctgaatcgttagtcacttcttttgctttagcgacggggtcttcgtttaaactgtttacaaccgcatcagcgcctaagctcttagcaaaattcaatttttcatcgctaatgtcgaaagcgatcactttagcgttaaagacgttttttgcatattgaacagccaagttgcctaaaccgccgactccaaatacaccaatccattgacctggcttaatttcactgactttaacggctttataagttgttacacctgcacaagtaatgctgcttgctgctgcagggtctaaattttccggcacctttattgcataatcaaccgctacgattgcttcttctgccattgcgccgtcaactgtatagccggcattttttacatcgcggcacaaggtttcacggccagttaggcaatattcacagcagctgcagctttcaaacatccaggcaatagagacgcggtcgccctttttcaggcttgttacaccttcaccaatctcagttacaatgccgattccctcatgacctaaagtgacgcctgtaacatccccgaaatcagcatttttaacatgtaagtcagtatgacatacaccgcagtattccatcttaactttggcttcaccatgtcgcaaaggacgtaattctttttgtacgatcgctatacttttgtcttttgttgctactactgctttcaaatcatacacccctttcaaatattagcagaaaatttttacttatcttacaatttagcacactgcccttcttttgaaaacccttacattttttgcggacaagtgtctctataaaaattgagggagctgtgcagggaggattctatggatgatttgtcatctccaaatgcatagaatttacatatatacatgaatggatacgttttcaaaggaggcctttttttgagcgataaaaagctgacggaagataaatttgacaatcaccggctcactaagtttttgcccttatcagccctaaccctgttacatcatttaatccggttcaaagataccctaaaataatgctgttatcacaaatggtgtacgaattgcaccgaatcggttcgttcctccaggtgccgacatagatacacaaaaaaagctgacagactcagacgagtgacaaaagaggaacgtgaatttacattggaagtgcagcgcgtaaatcaagaatttcccgcttcttataaagcgttattacaagaagggttgaaggtgagcagggcggcggattaaaactgatcttcccgcaaatttattccaataggactgacaggcataaaaataaaatgataaagcttcgcgaatgagcctaaaagcggctcttttataattcgcctttaacgctttaatggagaaatgcagcacttatggttctgctggataagacaacttttcttatacaattagacatcttgcaagttacttatttttacataactgttggaaatcgtctttctatctgagataataaaaatcatattgattgatacatgggggagtgaggatgggccgtttttatcaagcagcaggcaaaccattttacaaacaaattcctcaagctgtttttataaccgaagaaattagtgctttggataaacgctgtaagaaagactttctgtttaaataaacgaggtgaaaatcaatgaatggtatagaattcttagaatctgtgtcgcgacttggacaactcattttggtgttttcctgctacgccgtttattggaaattgggtaaaacgaaaagggagcgaagacttacaaaattcgaagctttgcttaggttctttgtaatgtttggtctatctgcatgggggctgtcgtttcttgctttgaatttgtggtcataatctttctgccgatatttgagcttaaactgcagagaattacactggcaggatatgattttacccttagtgaaaagaatttcacgggtaatcatttgaacttgagcgcggctgataaggtgaatggtgatgcaaacagaaatcattacttattgatcacaaaaggagccggctgcggagatgtgtggattaaaggcttttacggattcgaacacgatgagccggatgcagattggtgagagatacacagtcaaggtatttccttgaccttttttaatggcaataaaatttctggatattaagatagtgaattgatgatctgccaaaaaacatagatcttttaaagtgatggatatatattgattttaaacagtaggaaaaaatgagaaatgtattttgataaaaagcaggtgaactatatggaagcagcgtcttggagcaaaagtcaaagctgtacctacacattggttttttcaagtttgtcgtatggtttgatattcggactatatatgtttgtatactcgggttttgtgccatttgcattggttactgtggttatcattgctttttacgcattcattacttaccttttgtttgctgttcctgtgcaactatggctaagaaagaagcctaaaaagtttagtgtggttcatcttttcatttatacagcagtcgcttttttagctgtgttcttgttctggtacatagataatccgccaattgatttctcagttttcagcactttcatttattacataatgagcattgttgctgcgttcatatattggttctgggactctatatttctgagaaattacaatactccccagaagtaaagctgatgttctaaaaaagaccgactagcgccatgcccagtctgcattgttcaaattgaaattcatgtgatgaacccagaaagcgggtgaggaaaaatggaatacattgagttgactagggacaatattgatgacaatcatatttgctgtgcattaggtacgaaacaatatgaggatgcggtaaatgaaaagaagagctggctcaaagatcggatgagtgatggcttggtgttctaccgcctaaacgaacgggccaaagtttttattgaatatttacctgcagaagaagcgtgggtcccggtaagcgcacctaattttatgtttattaattgcctttgggtctcaggtaaatataagaataacggacatgcgaaacacttgttagaaaaatgtgtgtcagatgcaaaatcccgcggtatggatgggatagttcatatagtggggaagaaaaaactcccttatttaagtgataagcatttcttcgagcatatgggatttgctgtgcaagatgaagcagaaccctattttcagttggtgtcactgacgtggaaggaacatgcacatcctcctgtatttaaaaaaacaggtgaaaagtaattccgttaatgatgagggaatcataatattttatacagctcaatgcccatttgcagtcggagtgttaaaggatttaaaggaactgactgaaaagaaagggcttcattttcaggccctgagaataacgtcaaaagatatggcgcaaaaatccccggcagtttggacgactttcagcgtgttttataatgggacatttctcactcatgagatgatgagcgtgaataagtttgaaaaaatactcaatagcttaatttaaactatcttaagaataacttcgagggaaatgaattctgtaatgcctttactgcgctgttagctgtttttggcatgaataatattgggttgtcacatatgaaggcatctaggtgtattcgttatctcacttccctgcatttaagactgggatccatattctttataaccatcagccgatgcattttccccgatttgacttgcgggagaaaacatcagtttgatggttatttttatgaacggagaaagttcaacgcaacaaaaaagaagttcttcaggcattatatcctatggtaaaatttagacagaaagaagcggaaaggagacgtaaatgaaggtatttgaagcatcctcgttcatttcagcagcggagaaacgagcaaaagaatacgatcagattagagaacaatttatcaatctcagaaaagcgtttcagggaatggctgatctagacgacagtgagttttcaggtaaaggtgctgataacatcaaagccttttttcaagaccacgccggtgtcacagacagctggcttaatctgatcgatatgaagattgcgtttcttaacagtatttcaggaaaagtggctgatgccggattagctgattcgtttgtggaagagtcatttttagaacatgagctgattcatgcgaagaatacatcacaagccatcatgcaggagcagcgcaatgaaatgaaaggtatccttgatgaaatcagcgatatcattcatctagaagttttctcgacagaagatgtcgatcaaaagctggaatcagcagacaaaaaacgggacgatactgtacataagctcggcaagcttgatcacgatctaacgaaagaatacgcagaaaccgaggcaaacgaacatttcattcaggcagattttcagcagctccaaaacgcaacaggccaaggaaaaaacgccactccgcttcactataacgccaaggcatacagggaaagtgacatacataagaaaaaaggcgagattgcaagacattcggatgattatttgacgattaaaaaggaagaagcgaaggagcgggaaatcaaggatctgaagaaaaagctggccgctggtgtcaccgatccggatgaatatttggaaatggcgaagaagatcggctatgaaaaccttgaaccttcccaacagcaatatgtcattcagcttgaacaagcaaaacagatggaagaagccggagaagtgacttgggatattttaaaaggagctggtgtcggcctttatgatgtcgggaaagacacggtaacaggtttatggcagctgatcagcaagcctgatgaagttgttgaaggtatcataggggcagttgctcatccgattaacacgtataattccatttcaacagctattgaggaatcatatcaaaaggatatggtaaatggagatgcgtattccagatcaagatgggtgacatatgcggtcggttcagtggctgtggctgtcgtcggaacaaaaggcgcaggagccgttaacaaagctgatgcggcggggaaggtcataaacaaggcaggacaggcaggtcagaaaattaaggacattaagatttcagatttgcttccttataactctaagtatgatcttgctctggctgataacgtaccatacaatgtggttaacagccaaaaccttaaaaatggacttttgtccaatgcaaagaaattggatgaaagcagaaagccatttactggtcagaaagtaaatgtcccttggttaaataaagagaagtatgaggcctatgaaatagacggcaaggtaaaagttaaaggagagcctagagatgtaagccgtagagtatacacaatgaaagatattgaccttaatcaaaaaaatcgtaaaggctttacgaatcttcaactgatgaaaaatggtaatgctccttttgctaaagatggcacgcaaataaatttacatcacttaattcaagaagagcctggtactatgctggagatacctgaaagctggcataataagtacagtgatgttttgcatggattaaaagggaatggacagagttttagaaatgctcctgtgcttgataaacaatataaaagtttcagaagaaggtattggagatggagagctcagcaatttgagaatcaagaataagaggtgaaagtttaatggattattcgaaaataaaaactttctttgatgaaaataaagaaaattcaattctcacggggggagtcactgaagatcagattagagaaatagaagaggatctcaatgtaactcttccagacagctataaatggtttttaactgagtatggttcagggggagcatacggaacaatgattctcggatatgactctcacggcgctgaagttgtcgagcagaccaatgaatataaaaaatattataacctttccgatggtcttgtagtgatcgaatatgtagatgaattttcttattgtcttgacactaacaagatgatagatggagaatgcccagtcattctttgggataaccaagagggatatggtaaacaagttgctaggacattccaagagtttttaatagaagagcttgaagaatcgaaagacgactggatcgatgatgaggactgggacgattaaaactaaaaagaaggtctatatctgtttttccatagcatatgaaggagtattaaaatgagcttcactaagatcaaacaaaagttgaaagagtttacgattaatgctggcacagatcctagcattaatacaaacgagcagctcaaagaaattgaaagaaatttaggtaatcaattgccttccgactataaggattttttgaagggatatggaggctgttatttagaaagtaaaaaaacaacagatgagattgagtatgacgtttgctacaaacctatagagaaagatccttggatgggtaagggagatgatacacaattgttagagggtttttatggtttagcgaacgatcatagcagtcttcagaaagcaatcgatacatattctgatcgctttcctagaaatattattcctatagcaagctcggcaggtgggaatgaaatatgcatggatatcgataatgaaaagatattgttttgggatcatgaattaagtcaccccgataaagactttttccttattgccaactcttttgaagagtttattctaagtttagtagatgaaccaattgaaactaatgaacatgggagtgatgtggaaattgagattttagacaatgattttggaaaattgctctttggtaaggacaattagcttttatttttaggaaaagtattgcaaagttaagctctcagaaaaagagcttttttattttcgatagaaactaattataaaaagggagagaggttatggattcgtaccaaataaagaaattaaaacccgaagaataccataagtgtaataatatttgggacatggaaaagaaaaagaaaatggctaaggtgttttatgacgaattagtaagcggaaacagaattacttttatttactcagtgaatgacgagtttataggagaaggatcgttagtttttcaaaatgatgacccagattataccattccggataaacgcatttatctatctcgtatgattgttaaagaaggatatcgaaattgcgggataggcggtattattgttgattatttgattgattatgctaaacaacttggatttgaggaaataacacttggtgtagatacagataacttaaacgcaagacatctatatgaaaagaagggctttacaaccgtattatttcttggtgaagatgaatatggtgaatatgtaaaactccttaaagtattaaaataaaattcccgagaattatggtgaatgtgtgggaggttagtttcacaaacggtgatagacggtaacttaaactaatctaattggatcgttatttaagatgcggattagcatttattctctcaaaaccaacccgtaatgaaataggatactgttggttgaggaattgttttttccatgtattgtattttgtggtattcttgaaatgaaaggaggagacaatgaaaaagaaattaattggggtcttgatcattgtttgtttttctgtgttcatgtatggcgcagttacacattcttttaaacatcaaaaatccactgaggaagtattagaaagcgcatgggatgaatttgacttatttagctttgggattggagaaacagacccagtcatatcaattggtatggataaaacaaaaagtgaagaagaattacggcgctatttaaacgataacttatctgaggaagttaaagaagaatataaagttgagatcattaaaaaggatattaatgttttagaaagacaacatgaaaagtatttggaaagtgttgaagcacattgatacattaaagcttcttctcggctctaaataaaataacggtgatatccaataaacaaaagtattgcaaatcatttcaatggttccatggtacagtgtatttctttaataagaaatgcataataaaaagaccagggtgttggcagcaccccggctctgtacaaaaagttgcccaaccctttaagtttccaggctcaagggaggtctattttttatttatatacgtcaacagggcgattataatcgacccgaatgcaagcattcacattaatgcctgaaatgttgacataagcatcacctcctttccataggggatgagcaagactcccttgagcgtaaacgcctaatattcagaaaacattatacactagttccatttatatgtcgttaaaaacaatatacagttaccaaaacgaaaagaaccttgttagagacaggttctttttgtatttgagttgaatttatcaatagaattaccgataaataacgtgagaaataataccaggtagttacagaattgaaaaatgcttaggtgtgtaatacttgcactagctgtcactttgatacagaagctgctgaagcttcagtcttcagattcttccgttacattttaaaggcccctttatgggctcaaattcaaccgtcattaaagccaaaggcggaaggaatttgttatacaaaggtgaagcaaacatatacaaatatgatgctatacttgggcaaaacagggtagtgatagacattgaaattacaatgaacgaacttccttcaaatgagattcaagttgaagggcttggaaaaaatgaaaatcatttatagtaacgttgtaaaatttgagagagggtgaatgctatggaaggtctaaataactcttacaattgagaaatcaagcaattcacgcgtataaaacatctatttaattttaaatcggcgtttcaggtgaactttatatcatttctgttttagtaaacatatttaaaaacgaaataggaattaaaatatgcagacaaagcggcgaagcatatcgcataaaaggtgttatcagatgtatgaccgttcctaataataaaacttatgaagaaaggaactctaacttgaaatcaaatttagtttcgtttctattagcattgtcaggatttatattcagtatttatatgcagtcaatggcttactggagcaatgactctatgttgtggtattgggtcggtgcggttttgtcgtatctatttgctgcaggatcagtggttactctgattcttaacaaaaacaaagactcaattctaacaataagttgtctcattttaatgattgtaaccgttatgcttattttagtcacaactttttggacgacttttatcattattgcatggcaatctgggatgtgaggctaaggggaatatgatcttcttagtatttttttattcctgggattagaatccctttttattattctttcaaattaaatgtaacaattctaatattcatacgttctaaatgataaaggcgggatgtcatgaaaaaacgtaaagtcattaaaacattgctggttattatcactgttctcataatagcagccggatgtgcactgttttctttaatttcaggagaaaaagtcaaatatatcggctatagccaaagcaagacgtgggaagcgtcaatcgaaaaatcaggcaagacctctatcggccctaactatttcttgaatttgtattacagaggtaataaagtgaatgaaaagaacacggtgattaagagattaacattatttgttgacggccggaaatatggtgaagataaagactatcatctttcagaatacaccggagagaaattagaaggcggcggaacgggagaagaccatattcagacgtttgaatatatgccggaaaatgaagtgatcggtcatgaaatcactgttgaagcagtatggaaaaccgatcatgagtcctattcagaaaaattcaacctgaaaagaacgcattggtatgactgaaagaataaaaagagggcggtataaccctctttttgacgcggagcctttatttttgtctgtttttcctcgatttgctgaagtcgataaaagaggcattggagccgataaaattacttactaagacatacataaagaaaccattaaaagctccctgccggcgtccgttaaaaagaatggataatgagataagcaatacagccgtaagcaagtctgcagccagacttattttacggtgagaccggaaatattctcttaatcttctgatgttgttcaaagcggacacctcttgatgcttatgtataagaaaataataccattgaaatatatgtaatatcaatgaataaggttggaaacggaggggttcaaagttggggcgatcttgtgtaaaagaaaggatcaggatgaatgtgaccagcatccaccctgatcaatggggttcacagtgttctatttcattgtattccaatcggaataatattacaagggtgaaaaagaaaaaagcggaatgttctcggctccttctgcttctggagcgggaaacggaaagtgagatgtttgtatgaaaataaatgattatctgaaggaaaggtttccgactttaaaattagtgcccggcatttatcatcaatgggacgttggaattcatttttctctcggcggcaatatgtatcaatttaatgaaagcggtgctttgaatcttgagtattttcagcttgttcatcatcaaaccgccgcacttttcaatgagctgtttgaacatagcgatgacatgttccttgttgccaacgtgtataagcacaaatctcaaggtaatcacgcgagaaaattaaaggtttatcagccgtttctgaagtgtaaggatgatttatatcggattcaagtgaagacctgtcaatgcccggtcgaagaagaatatgaaatgcagcagttttctttattatgtaaacggaaagatctgcgtatcccccaattacttaaggcagccgtccacgaagattttccgctgaagccaaggttcgggggctgttccgttgggtatcctgatgttttctttgtgaatatgacaaaagatattattttcttcctgtatgatgacagagggtgtgaagtcattgctcttgatgccggaagaatacgaaagctttatgatcaatatcacgattggattgaattggactgaaaatgaacacatgaattcgaatccgcttgtgccggctttgttcttgcctagtcgggctgcatgagtgtaatgggcagaattgaagggcgccggaaactttttttcctctcataccgaccttctgcatgttaagctactgtatttattttgaacgaattcctatttgtaaaacggctgaatagaataacataaaagctattttacacagtgcaggaggagagaaatgtgagggctgaacaccgtgattgtatggaaattggaatttattcatttgcagaattatatcccgatcctctgacagggaaaacagtcagcgcaaagcagcggatagatgaattgatgaagctggcgaaattggctgacgacgcagggcttgatgtattcggtgtaggcgagcatcatcgtcttgattatgcggtatcttcgccgccggccatcttatcagcgatttcacagatcactgaaaatattaagctgaccagtgccacgactgtattatccaccgcagatcccgtccgtttatttgaggattttgcaacgcttgatctgatttcagacggccgggcggaaatcattgcgggacggggcgcatttttagactcgtttcctcttttcggttatgacgtaggccattataaagaactgtttgaagaacacattgacctttttttaaaattaaattccggggaagaatcggttacctggaaaggacgttaccggccgccgctgcgcgaggcagaaatttctcctcggccttttcgcggaagcattccgctatggttaggtgtttcggggactccggaaagcgcagaacgggccgggcgtgcaggtgcgggtttagcattagctgtactgagcggtgatccggtgtcatctaagccgcttgttgacaaataccgggaagcggcttctaaagccggtcatcctccggaaaatgtgaaggttgccgtaaccggacatatgttcatttcaaaaacgaatgaacaggcaatacaagaattttacccgtatcattcaaattactggtctcatgttcattcatatcacgggatcgatgagcctttaacgaaggaagattttgaacgggcgtccggaaaagaaacagctttatttgtgggaagctcacagcagatcattgaaaaaatcatgcatcaatacgagttattcggacatcagcgatttctcgcgcaaatcgatataggaggtatgccgtttaaaaaagccgcggaaaacatcgaacgattagcagcggaagtagcaccggttatccgaaaagaaaccggcaaatccagcgaatgaagttctgagcaaaaggggcgggccggtttttggcaatcgcggattcgacaacagaatcggcccggctttttctttatgattataaaaaacaaaggggaaagcgcgaacctcattgctttttcctatcaagaaaaggaaggtcatttcatcctccatcgtgaagtgtatataccgaaaggtttttattaacaaaagagggaggatgatgaagtgatgaagggtttagtcaaagctgcagttttaactgttactcttggtattggaggcgctttctattcaagtgatgcatctgcgcacgggtatataaaagagcccgtcagcagagcgtacatgggagcattagagaaacaaacattgggctggacggccgctgcccagaaatatggctccgtcattgataatcctcagtctgtagaagggccgaaaggatttccggctgcaggtccgccggatggaagaattgcatctgcaaatgggggatcgggacaaattgacttcggtttagacaagcagactgcagattattgggtaaaacaaaacatccgcggcggttttaacacctttacttggtactacacggcccctcatgcgacatcaaagtggcactattatatcaccaagaaaaactggaatccgaataaacctttgtcaagagatgaattcgaattaatcggaacggtaaaccacgacggttccaaggcagatacgaatttgactcataagatttttgtgccgactgatcgaagcgggtatcatgtcattttaggggtatgggacgttgcggatacttccaatgccttctataacgtcatcgatgtaaaccttacacaataatttgtgaattactgatcggctgcatgttgatacatcggccgatctttttagttttaatgtgtgaatgaaaaggggaaaaacagcagagcgccataaacatttcatttatggcgccgtacgatcatggaggtgctgctgacatggatgcggaggtaagaggattcttaataaccgccgaggaaagaagccccaacgatgattaataaaatgaatagcaccacgattaacgcaaaggagctaccataaccacctgagaatcccatataatctcacctcctaaagaggattaatacatattatgccgaaatgaaaagtttgatagggatgctagtttactttttgaaaaaagggttttagtctatatttcctttacatgaccatccgttaaaatgagtaaaaggaggaatcgtactgcttcctgtaatagaaacggatatgctcatacattgagaagttgcgaagaggatgcgcagtttgctcgttttttttaaaatgaaaaagtaacaagctattaggattggaaccttttggttggtttcaagagcagcagcaagaaaaaagggaatgtgatgaggaatcgagaaaaaagatgcgaagggcataatcggaaccatgtatcaaaacggattgcctgatgatacacgcgtatactccattccgaatgggaacgttaacgatctaatagaagagcttcaagtgttctgcggtaaataaaaaaagccgatgaaggcttaacattgattagacgctgtaaagcattctttccgctgcgctttctgcagacggtgtttgattgtaagaaacgattccgatcatcactaacaagatgatgaacaccaatatgctccacaacattatttttaaagactttgacatggcataccctcactttgaaagactttaccggggctgcgatcggagcccgcacttcaagtatagtcgttataacggtgaaaaatgtgcagtatcccgttatcaaaataaaaacttgcgggcgctgccgcaagttttctccgtattaaggtctgtggaattcaatatgctgattatcacgatcgaaccaccctctgaatgcccaattgatccagcccccgtcccctttgttatcgaaggacccgtcttcgaagacccagattccgtaagtaatgccgtcataaacggctgatccgtaaaactgaacgccgttaaagcggtcttcatattcttgatttaaattgaacaccatgacgttgtacttctgtcctgatgcgtaaaatgttgtttccatgacattttttacccagccggttcggttttgatctgacttaactgcttcagcaatgcgatctgagattccgagaacatctacgtttacgttcagcccggcatcaacacccgctgcttttacgttttggtctgctgtttgggataatttactttctaacggatttgcaacgggtgaaacgtgaggcgcgtttgcgtgttcagactgactggctgctgaggcactggctgtgaaaggaattgttagagataaagctaagcatgatccgactaccgttctggcgattttcatggctatgacctcctgaggaaattttttaaaattgttgcaaattcatggtatcgcagaaaaattgaccaagcaaagagtagattttctcaaaagtcatgtcattctatttgtgttgttttctgtaaatgaaaaccttttaattaggcgaaaagggaagaaaataatagagtctttttatgtattgtgacaggatgaccggattttgggtgaaaatagcccggagaaacgccataataagaaaaacacccggagtttaccgggtgtaaaaagtgttgatatgtcaagttagtagcattttttgcattttttgcattttcttttataaacaacgatgtaatcataatcaagatgctttttatcttgtttcttctttttttgtttaggctgctttgggtggtgatcataatgtccgttcatgtccatatccatacccatatccatactcatattcctccttttttcatctgacggtagtattctatgacagaaagcatggatggcttggacaaatgaaacggtatgctgaaaaagaggcatctcattcggtataaaaaacaggatcatacccgcccgatagaaaagagaggagatgatcctgatattgagtccctatttgataaccgcaattgcaatgccgtaccctttttcagaactgtataaggctgtcagtttcaataccttccagccttctgcggctttagtcccgattccgttatgagccgtgatataatctcccgggctgaccgtaccgtcgacccgtacgtaatgccggccgttgagtccgacaatgtgccattcgtctctggccgcgcgtgcttcatagtcagcttcaagagccggactgcagtctgggttttgtttcggcacgcgtaccgtttctcctgtttcttcgtcagtcacattttcgtatatgaaaccgccgaactcgtttgtcaaaaagcggctttgccatccgaagcttgcggctcctgagataaaagcggctgtttctgaaatgacgccgagcatgtaatctccgacgtgagccaattcaattttttcgcctttcactgtgacgatcgtcccggcgggaattgtctggccggttacactttcaaaatattctccataccctgacagggaagaggtgacagctccggcgaacgtaccgtggccgcccgctgaatccagtttccatttgatggactgatgccctccggcaaccgtgtatggttcttccaatgtaatgctttctgatgacagaatcgttctggagactttgctgcccgttatatggacattgtttgaagcggcgataaatgcccttgaaccttcagaacttgaacctccggaagagctgatgatcgcatttctgtcacctctggccgtaatatcgcctgttcccgcaataacggcgcttgtcgggttgaatgcaaaaccggagctggtcgcgagctgtgcgcctccctttaaattgacggggatctgctcataagtctgtccttttatagatgcggccgcgctgtaaccttccgcttgcaccccgagaatgacggcctgactgttaggggacgtaattccgaccgaaccgccgtctccgatcatcgtaccgttcataatatttacgttatattggcctccgccgattgagatgcctttaggagaagacttgtatatatcaaaatttgaaattttaacataatcggttttatttgatccgccggatatattgatgtcaacaccggcttgtgtaaagccgcgtattttaatgccgttaatcgtaatattttgactgcggtattgaagagccacgactggattcccgccatagtcgtatgagggatcaccaatagatgtgaatccgtttacattaacgtttttataggcagagatgaccagcgccctcggggtcacaccgtcatagagagcattgaataccggttcaatcgcggtgcaatcggttaaagtaacatcataagccgtcgtgctttcggggtctgaggcctgatgatggccgatatgacgaatatcaaatgaacgtacatcacgatacgaaacatgaccgataatatgaacattttgagaagccggccacaggctgtgcgcctttacctcaatcccgcggatatttccgctcgtatagttatttaaaagccatacatgtttagagccgtcgtcaatttcaatgccgttcgagtttgcgctgccctcagcatgctctgtgccgcgggggtttccggaatggcagttggaaatgaaaatatactcgctgtaatgggtggtaatgccgtcgtctccggcgccgtatgccacacagttatcaatccatatatatcggcagccgtctttcgtccattctgtttcaggcaaatgatcgtaagtcggagatgtaatatcaataccatggagacccgcgttaaccgtttcaacattcttaatccagccgtattgcacattagcaaacgttaaacagctggaaaactgtcctccggggttcctgaccccgcattgacgatcaggattccagtctaaagtcatgttctggacaaaaatattacggtttccattatcgtaatcatcgttagtaatgacccattcgtatgcgggagtgtcctcatgaagcttaagcacggtaatcccttgtccctcaccggaaatggtagtccatgaggggagttttatcccttgaaccaaaaattctcctgcggggacatttactttgacccggccgttcccgatcgctctccgaaaggcttccgtattgtcccggccgtcagggaccgctccgtagtcctccacattcacttcccgggtgattttattcataagcatttcgtattctgtatcaagccgttcttttaaaagtgaggtgaccattccttccgccgtcacccgggcatctgcgatctcaagattatcatccgttgcggaatgcttaataaaattctgcatccttgctttgagatgctccaattcagagggatgtgcagggcgagactgcaatggggcgtttaaagacggatcaggaaagtttttaaattgaaccattctaaagacacctctttcttttgatataagcgcctgaggcaggggacagaaaagagtcgcgcgccctttaaagcgcttattcttcaaattctttattcagaacgaaattccttttgaaaccaaggtgaaatttaaaaaaagctctgttgaaagaacggatataaagctttgcattattgtaattgaagctgtcatgtgaaaatggaggaaaaaactgataggaagggccctcattttaggtttattctcattgacttcgccgtgcttcctcttcggctgcatatacaccaaaatcaacattcttatcagttaaatggtataatggggcacggattggtcatcaatacgactgaaatagggaagcaaaaggagcagcgaacatgactttaaaaatcaaaattaaatattcagatgatacgcaaacgagaatcagtaaaattgaacagggcgattggattgatctgcgggcagctgaagatatcacaatcaaaaaaggtgaattcaaacttatcccgcttggagttgcgatggaactgccggaaggatatgaggcccatgtcgttccgcgttcaagtacatataagcatttcggtatcattcagacaaattcaatgggagtcattgatgaatcatataaaggcgacaatgacttctggttttttcctgcattcgcgcttcgggataccgacatttccaagggggagcggatctgccaattcagaatcatgaagaaaatgcctgaagtggagctgatcgaagtagacaagctcgggaacaatgaccgcggtggactgggatcaacaggcacgaaataaaacgaaaaaagactgcttaacagcagtctttttttatggaaacagcagttacattcaatttgtttcggggattcttgaattgggaaatcatacgtcacgttcgaatttgacttcgaaataagcggccgctccgtaaccgtctatgccaagagcaaatatttaagccttccgtctctttgaacagaaagacttttttaggttaaaggatagaagttgttttgatgtttttattcttcaagatgaacggaggttttgtccaacgtatataatattgtgacaaaagtgtaaacaaaagaaaggatgatgttatggcaaaaagggttagaagagtagaccataaagcagctggcaaagaggcagagcagaagaaaccgtccaaagtcaccctgttctgccgttcgcttcaaaggctgaagcatttgtattgtaacataaacatacaaatgccatcaataaccaaaaaaggaattttagttttgattttaccgtttttgcttctgccgttctttcgggctaatgccgcttcagatatttacggcagtttcgaggaattaaagttgaatgaaaatccttccgatttttccatttcaacgcgagagcataacccttctgtcctcatattagctatacacggcggaggcatagagccggggtccagtgagttagccagagaaattgccgaaaaccggagtttgtatttatttgaagggttaaaatcagccggtaatgcggctctgcatttgacaagttcgcatttcgatgaacctaaggccgtgcaaatggtgaaagagcactctaatgtcatttcattgcacggttacggcagtgatgataaaaagataaaaatcggcggtacagacagagaacgggccgaacttttgaccgatgtgctgaaacggcacgggtatcctgccgttcttcttggcataaatgataaatatgcaggcgtcagtccgaacaaccttgccaatcaatcttcatccggattgagtattcaaatcgaaatgagcaccggcttcagaaaatcactatttgacacttttacgctgaaaagcagagcatccacacaaaacgggaccttttatcaattcacaaaaacgatttctgattttatcagtgacaattatgaataagcacgcctattttgtcggcggggctttttcttttgaaatttatgaaactttaagttcttaagatcgtatacataattgacaggatgaaagaaaagaggtgggcaaatgaaagtgatgatcgggtctatcattcttcttgtcatcatcggattcggtttatggctgatgcttagtccaatctttaaacaagtgggaagcagagccaaaaaattcaaaaagtcatgggaggaagaagatcagcatgagcgaaaataagcgcggaaacacaaaaaaaattctcggcggtgtgattataggtgcagcccttttaattgcgggcgttacagcgtcactattcattgaaaaaataccgaacggttatgtcggggttgtatactcaccgaatggcggggtaaaatccgacacattggaccaaggctggcacttagtcggtttatttaataaagtaacggaatatccggtgcgtatgcagacagtgaataatgaaaatataaaagtggcaacctcagacggtaaaaatatagaaatggatatcgcttacaactatgtcgtgcagcctgataaagtagtcgatctgtttaacaaattcggcgcggtaaacgttgaaacgattgaaaatacatatttaaaaacaaggctgtgggatgcggcgcgaaaatcaatcagcaaatactcggttattgacacatacgggcaaaaatctgcagaagccgctgccgatgttcaaaagagatttgctgatgatatgaagagtcttggatttttaattgatgatctcacgcttggcgtaccgaagccggataaagccacacaggaagctatcgatgcaagggtgaagtcttcacaggaacttgaacggacacaaactgaaattaaaatagccgaagccgaagcgaaaaagaaaaaaattgaagcggaagggatcgctgattacaaccaaatcataaagaaatcaatgtccgatgaaatgatcaaatataaatggattgaaaaatgggacggaaaaacgccgaaagcgacaggcacagactcgctgctgcagctgccgctggacgatcagaagcaaaaataaaaagagaaggaggcgattgcctcctttttatgttttttcctgagggtctttttccggcactaattcttcagacgcctcggtttgatagctccatagcgtgctatccgtctctgttgtgtcctgataatcttcgggaagtacatattgctgcaaataccggtgaaaaaatgcctcgaaaacagaaatgcaaagtgcagagataaccgatgccgcggcaggcgagacattaaatccgccaatgttcataaggaatatccataatacaatgaatgaaattccgaaatcagctgcaacggctgtgaaattgcttgttctcggcagaatcatgcaatcacccgcaaaataagtaattaaacttaagatcactgtaataaacagaacgtttaaaaaggttacttggtacataagatccagaacaatgtacagtaaagcaagtgtgagcgccgttttagaagcgaaagcaattacgtgtttcatttgaaccaccttcgttatttcgtttagtcttcattgtaagcaatccgcaaatttttaaactggtatatagtggttataaagtatacgttttaataaaatgtgaatagacatcacaggattcacaagttaaaatatgtaaaaagggggatgcaaatgaaaaaatactggatttgtattgctgtttttttattatgttttagcggaatacactcagctaaagcggctaccactgaattcggatcaaaaacaagcttcactttggagggaaatgcaaaagagtttcatattgaaaatcctggggctgtagctgccgacgattactttttaggatataagttcaccataatgaacaactcttcgtgcggtttgagcatgaaactccagcggatggcgctgaacggaaatttttatacattaagctctaaaaactacagcggcagctggttaaaccttagtgcccaggataaaaaatcaattgatccgtatcacaaatacagaattctggttgaaagttcttcaaacgtctgtggccccgcctatattaaagggttatacggtgtagaatattatcattttgattgaaaataggtactcgctaaaggcagcgggtttttttatatttaaatataacctattgtactatgtactaaatattcatatataaatttttgatcgccctcccaaaagaaaagataaacaaaaacaaattcatcacgcacaaatatacaaagttgaaaaatggatgaaaagtttctctagggaaacattattagttgacttcaaaagtgtgatgtcggataataagaatgtaagtttttcctccttagcagattcgtttcttaagccagggcgaatctgctttttttatgcaaaaaaacccctctgtaaggggttttttacgataaatgaagtttaatagaattaatgtacggctctgaatacgccgataactttccccaaaatgcttacgttttgcaggataatcggctccatcgtcggattttccggctgcagccgcacataattgtcttctttatagaagcgcttaaccgtcgcttcatcatcttcggtcatagctacgacgatttctccgttattggccgtgttctgctgtttgacgatgacgtaatctttgtcaaaaatgccggcgtcaatcatactttctcccatgatttctaacataaagacatgttcgcccggaggaaccatccggtcaggaagcggaaaatactcgtcgatattttcaacagccgtaatcggaatacccgccgtcactttcccgatgaccggaacgtttacgacctggcttttcggaatttggacttcttcttcatccaatacctcaatcgctctcggtttagtagggtcccgtctgatcaggccttttgtctccagccgcgccaaatggccgtgcacggttgaactggaagccagtcctactgcttctcctatctctcttacagaaggcggatatcctttcgtttttacctcttctttaataaaacgcaggatatcaagctgcctttttgatagcttcgtcatatttcgcacctcaaaacgtcgattttaagtagattatagcatgattttcctgacagtacaaacataggttcgaaaaaacgattgacagaaacgtttgttcgtatatactgaaaggtataaaaagcgaacaaacattcttattggaggttgtttacatggcgaaagaatctattatatttgtcggactgtttactgcgattttaagtgccgctattttacttgtctcatgtgcgggaaatgatcagtccctcagccaatatgttaaaataaaggttcaggacggtgatacactctggtcacttgcggatcatgtagcagaaaagaaacacattaataaagaagatttcattgagtgggtgacggagaataaccatctccaaactgctgatataaagcccggagacgaacttattcttccggttaagaagaagcatccggccgtatatcagctggccattgtcaattagagaggaaagagagaaatgaaggcgctcatttatgcccgcgtaagcacaaacaaagaacagcagcaaacgtcattaaaaagacaggaagaggagctcagtgagatcgctgctgcaaacggcatggaagtcgtgaaagtcatttctgagaaagccagcggttacgaaatggaccgcgacggagtatttgaaatgcttgatgaaattaaaaaatcacatattgacgcgatattggtgcaggacgaaacgagattgggaagaggaaacgccaagattgcgcttttgcattgcatttacagggagaacgtaaagatatatacgacggctcataaaggtgaactggagctttccgaagctgatacgatggtacttgaaatcgtcagtattgttgaggaatatcaaaggaaaattcacaatatgaaaatccggcggggaatgaaaagagccatgaaaaacggctacaaacctgaacggaatctgaaaaacaggcatgaaaacagcggaaaagaaaaaaaagaggttccggtttcggaaattatcaggctgagagccaacaagcttacctttgcagaaatcgcagcgaccttaagaggattcggctatgatgtgtccaaagccacggttcaccggcggtttcaggaatataccgcagatacagaaggcagctgacgcgcatcagttgtaaaaaagactgcgttttagtagtatataatcaacacgcaccaaaggagcttattatgatttctaaagaaaaaatcgcaagaattaacgaattggctcaaaaagctaaatcaaacacaataacggatgaggaaaaagctgaacagcaaaagcttcgccaggaatatttgaaaggattccgctcctcaatgaaaaatacgttaaagagcgtaaaagtgattgatccggaaggcaacgatgtcacccctgaaaaattaaaaagagaacaacagaaaaataatcttcattaaacagaaagaatacggcaatacgtattcttttttcgtatatactaatatcaggatgtgctttacgacaattttcaacaagtttatctcaaatttaagctgaaagagttgagaaaaagtcagcatcgctttatgatgaaaaggtacaacaataaggaaggggattataatggatacaattgaaaagaaatcagttgccaccattcgtacactatctatagacgcaattgaaaaagcgaattccggacatccgggcatgccgatgggagccgctccgatggcatatacattgtggacgaaatttatgaatgtaaatccgcagaatccgggctggtttaaccgcgaccgctttgttttatcagcaggccacggttcaatgcttttatacagcatgctgcatttaagcggatatgacctcagcattgaagacttgaaacagttccgtcaatggggaagcaaaacaccgggacatccggagttcgggcacacagccggagtagacgctacgaccggaccgcttggacagggtattgcaatggcagtgggaatggcaattgcagaacgccatctggctgagacatataaccgtgattcattcaacgtagttgatcattatacatacagtatttgcggagacggcgatttaatggaaggcatttcttccgaagcagcttctcttgcaggccatcttgaattaggccgtctgatcgtattatacgattctaatgacatttccttagacggcgatttagaccgttctttctctgaaaatgtaaagcagcgttttgaagcaatgaactgggaagttctttatgttgaggacggaaacaacatcgctgaattgacggctgcaattgaaaaagcgcgccagaatgataaaaaaccgacattgatcgaagtgaaaacgacaatcggtttcggttctccaaaccgcgcgggcacatccggcgttcacggcgctccgttaggacaagaagagagcaagctgacaaaagaagcgtatgcttggacgtttgaagaagatttttatgttccggaagaagtatacgggcatttcaatcaagctgtaaaagaagccggctcgaaaaaagaacaggaatggaatgaactgttcgcggcttataaagaaaaatatcctgagcttgctgaacagctgtcactcggcatgaaaggcgagcttcctaaagactgggatcaggaagttcccgtttatgaaaaaggcagcagccttgcttcccgtgcatcttcaggtgaggtgctgaacgggatcgccaagaaaattcctttctttgtcgggggatctgctgaccttgcgggttcaaataaaacgacaatcaaaaatggaggagacttcacggcaaaagactacgccgggaaaaacttctggttcggtgtccgtgaatttgcgatgggcgctgcattaaacggaatggcgcttcacggcggcctccgcgtattcggcggcacattctttgtgttctctgattatttaagacctgccattcgtctggcgtcattgatgggtcttcccgtcacttatgtattcacacatgacagtattgccgtaggagaggacgggccgactcacgaaccgattgagcagcttgcttctttacgcgcacttcctaacctttctgtgatcagacctgctgacggaaatgaaaccgcagctgcatggaaggttgccgttcaaagccaagatcatccgacagctcttgtattgacacgccaaaacctgccgacgattgatcagcaggctgaagaagcgtatgcgggcgtggataaaggggcttatatcgtttccaaagcccaaacagaatcaccggccgctcttcttttagcgacaggttctgaagtcggacttgcgatcgaagctcaagcgaaactggctgaagaaaacattcacgtatctgtagtcagcatgccgagctgggaccgctttgaaaaacaatcggccgagtacaaaaacagcgtgcttcctccgaatgtgacgaaacgtcttgcgatcgaaatgggttcaagcttcggatggggcaaatttaccggtcttgaaggagacgttctcgcaattgaccgtttcggtgcttcagctccgggagaaacaattatgaaagaatacgggtttactgcagaaaacgtggttgaccgcgtgaaaaaacttttaaacaaataacgagacaaaagaggatgagtcaaatcatcctctttttcctgtttatgcgacaaaaatagaaggggcggcgcaacagtaatagacaattctttcttttctccttttgtataatagaaagcaataacgaagcgctgtaaaaggggatgaggaaatggaacgtcattactatacgcacctgataaaggatgagtttgcgaaccactacttcgggcgggaaacggctatgtttgagttgtttcgagactatcattggacagatctgacaccccaggaatatcaaatgacagaaaagcaagttcaatatataacggaaccgattccggtgatacatatgcatcagcgtctccagctgcatttaaaccgaatgagttacagccgtttggattccatttaccggcttacactgcccggagaaaagggttgcgccaccttcatgatgaaagacagtttaattgagattgcagcttcgggagattatgaggcggaaacgattttctttgagattctgcgtaaaatcagcccctgttttcttgcaatggatttcaagacacggcgctacgggtggttaaatccggtcagagaaagaaattttgtctaaaaacgaggaaaaagagatgtaaatgttgtataatagcctttggtttagtacactttaaactagacaacatgaaggaggaaataaaatgactttatgggttggcatcctagtgggcgttgtcgcattgctcataggtgttgcactcgggttttttattgctcgtaaatatatgatgagctatttgaaaaagaatccgcctattaatgaacaaatgttacgcatgatgatgatgcaaatgggaatgaaaccttctcaaaagaaaattaatcaaatgatgaaagccatgaataatcaagcgaaataatacgtacagattatgatatagagatacatggttataaaaataaaaaacccggagagggttttttattttggcgtcatgtttcaccccaactgccggtgtgcagttctttttgatattgtatgagaaggtggtcaagctcctggctgagttctatcgtaatgtttgatgtcattccgtttgtcatgacgattttaagcagctctgcccgttttttttcaatttcatttaatagatgctctctaatcacagggatatatcctttcatacataaatctttcacctgagtcgctattattatatccacatttatactgtttttcaaataagaaggagtataatatctcgatgtcaaattaaattatataagctttttctataaaaagtaatccttctcgggaaagtgttaaaaaaatgaaatgattttgtcataactcgaagggagtgtgtcatcgtgagttttaattactttctgacgtttggggccggatttctgtctttcatttctccatgctgtctgccgttgtaccccgcctttttatcttacataactggtgtcagtatggacgaggtgaaaacagaaaaggtgatgctgcaaaagcgcggcctcgtgcatacactttgttttttgcttggtttctccgtgatttttatcgcattgggatatggaacttcatttatcggcagttttttcacccaatatcatgaagcgatccgccagtttggcgctatcatgctgatccttttcgggctgattactgccggtgtgtttcagccgaaattcatgatgaaagagcggcgcattcactttaagcgccgtccggaggggtttatcggttcggttctgatcggtcttgcgtttgcagccggctggtcgccgtgcagcgggcctattttaggagccgtgttttcgctggcaaatacaaatccttcttcagcagtgccgtatatgtttttatatgttctcggttttgcgattccttttcttgttctttcattttttattaccagaatgaattggattcgcaagcatcagctgcttatcatgaaaatcggcggcattcttatgattctgatcggagttatgctgttttttaactggatgagctacattctgatcgttctgtcaaatcttttcggaggatttacgggtctgtaacggattaataacttttgaactattatataccctttcgtttttggtacaataagactagttaatgttaaatatgtggaggggaatatgacacgagttttagttgtagatgacgccaagttcatgagggtgaaaatcagagagattctggaatcggcgaattacacagtggccggggaagcggctgacggggaggaagccctggcagtatatcaaaaaatccgtcccgacctggtgacaatggatattaccatgccggtcaaaaacggtatacaggcgctgcaggatattttagcttttgacccgaaagcccggatcatcatgtgcaccgccatgcggcagcagcggatcgttctggaagcgattgaattaggcgctaaagactttatcgttaaaccgtttgaagcatctaaagtgctggaggccgtaggccgggtaacgggaacgtaaacatgttctcttttcaaattggttttttttatgtttttggagtatagtatatagtatcaaactccgtgcaagcaaaggaatgataaagatgatgattataatttcatccgttattgcagcggccatggcaatttccgtgatgatcgtcaggattaaatcctccgacaagcccgcttcacctaaaaaaataattctcccgccgattttcatgagtacgggagcgcttatgttcctttttccgattttcaaagtgtcgggcgaagaatttttggaggccattacgctgggcgtaatcttctctatttttctgattaaaacatctaaatttgagattaaaaataatgaaatctatttaaaacggtcaaaagcgtttgtgtttatcctgattggtttgctggttatcagaatcgctatgaaatccattttgagcacgacgattgattacggagctttaagcgggatgttttggattcttgctttcggaatgattgtcccgtggcgcatcgcgatgtttttgtcttaccgcaaactttcgaatgaactgaagaccgctgatattcagatgaattaaaacctttccgtccgccggaaaggttttttatttgagcaggtcttgataaggagtaagatcaatctgtttttcacggagatgcttttttaaaaattgatgatcacgcttaggagtggccagtatgtaacccctgatgattaaatcacggtttatttgttcagcttcctccgctaaggaaagttcaccgatttttccggcgattttcgctttggctacatcccgaaagagctccggcacgggggcgaccagttcatccaaaaacgccttgtcaccctcattccataagtgcctgcttttttcaatataatagtcctgccaatccagttctgaccggccgtcttctttcggcaagcgttttaaaaattttcgaaacataaaaaacccgccgatagacagcaatccgatcatcacgatgacccaaaataaaataaaccacataaaccagccttccagcattgttctatctcctccttactttaaccatattgtaaacgaagacagaatagaagaacacatgaaaaaaagaatagaaaaaatgatagatgtccagtcattccggttgctagaacatattctatcgtatagtgattctgctatttggccatgggagattcactttgagggtatatgactgatatgaccggacaaaaaagccgcttccattgagggatgaaagcggcttttttatgttatagaggaaattgaaaggaaaaagaggcaggagtctcatttggctccttgttcatggagacggtcagaatatggttggtgaaatcagtgaaaatatgtttgtcattcagataaaaaggaagcaccatttgtttgtttaacgtccgttcaagcgttttaacagagagcataaactcatttcccgaaagagtgacggtgatcgcctgcacctgcttcagcgccgtcaggtcggcttcaatgatatattgacggcttgtttcatatagatcgatcggcagcgtctcgtcataccaagcatacgggtcctcgtaaaactgccgcagccattcttccgtatcatcaaattcttcagcgttttttgagtgattcatggaagcattcctccatattaaaaagccttgctataacgtatgcagaagctttgaatgggtgaatggcacaaaaaaacagacaccggggtctgttttacatatcgtggcttgtattatgtttttgtcttgtatggttgcggtttttcacttttttgcttccgctcagcggttccggctggccggggttatggcccttcggagcatttttatgcatatctttactcgtatttttatttgtcatgttaaagcctcctttttaaggtgttccggctattggtttgtttttctttttttattgttctgccgttcttcttccgtcaggacgagctggtcattttctatataacccgcgccttttccttggcttttcgcatcattcatgccgttaatcacatgattggctttccgttttaccatgatcatcacctcaacattaatatggctctttacagcccgttgtatgaggcggaaaatcggacaaaatttaccgaaaatcatgctgataagacgatcttattgtatttaataaaaacattgatatttacttatgtatgattttatactaagatgaaattgtgagaaaattgtgatggaatgtgaacattcatctaaagaacgatcttgatcattgaagggggattttggagaatgacaaatcagcaaaaagtcgcaacacaagacgttttccaagcaagaaaaacattttcttcaaatgggaaaacatacaactattattcattaaaagcattggaagacgcaggggtcggcaatgtttcaaaacttccttattctattaaggttcttttggaatccgttttgcgtcaggtagacggacgcgtcattacaaaagaacatgttgaaaatttagcaagatggggtactgctgaattaaaagatatcgatgtgccgtttaaaccgtcacgggttattctacaggactttaccggcgttccggccgtagttgacctggcatctttaagaaaagccatggcttctgtcggcggagaccctgataaaatcaatcctgaaattccggttgacctggtcattgaccactccgtacaagtcgacaaagccggtacggaagacgcgttagccattaatatggacttagaattcgaaagaaatgcagaacgttataaatttttaagctgggcaaagaaagcgtttaacaattatcaggctgttccgcctgcaacaggtatcgttcatcaggtaaaccttgagtttttggcaagtgtcgttcatacgaaagaggaagacggagaacttgtgacatatcctgatacattggtgggaacagattcccatacaacaatgattaacggaatcggcgtcctcggctggggtgtcggcggtatcgaggcggaagcgggaatgctcggccagccttcatatttccctgttcctgaggtcatcggcgcgaaacttgtcggaaaattgcctaacggaacgacggcgactgacttggcgctgaaagtcactcaagtgctgcgcgaaaaaggcgtagtcaataaatttgttgaattcttcggtcctggtgttgctgagcttccgcttgcggatcgtgcgactattgccaatatggcgccggaatacggagcgacttgcggattcttccctgttgacgaggaagcactttcttacctgcgtctgaccggccgtgaagaagagcagatcgatattgtggaagcatactgccgcaacaacggtttattctatacgcctgacgcggaagagccgatttttacagacgttgtggaaattgatctgtcaaaaatcgaagcgaacctttcaggcccgaaacgtccgcaggatttaatcccgctttccgttatgcaggaaacgtttaaaaaacatcttgtcagcccggccggcaaccaaggattcggagcggatgctgctgaagagaacaaagaaatttcatttaaacttaacagcggtgaagatgcggttatgaaaacaggggcgattgcaatcgccgctattacaagctgtacgaatacatcaaacccttatgtattaatcggtgccggattggtagccaaaaaagcggtagaattaggcttgaaagtgccgaattatgttaaaacgtcacttgcaccggggtctaaggttgttactggatacttagtcaactcaggcctgcttccttacatgaaggagctcggctttaacctcgtagggtatggctgtacgacatgtatcgggaactccggcccgctttctccagagattgaagaagcggttgctaaaaatgatctcttgatcacttctgtcttgtcgggtaacagaaactttgaaggccggatccatccgcttgtcaaaggaaactaccttgcgtcacctccgcttgttgtcgcatacgcattagcaggcactgtgaatatcaacctgaaaacggatccgatcggtgtcggaaatgacggacaaaatgtttatttcgatgacatctggccgtccatggatgaaatcaattctctcgtcaaacagactgttacgccggaattattccgcaaagagtatgaaacggtatttgacgacaaccagcgctggaacgaaatcgaaacgacggatgaagcgctgtacaagtgggatcaggattccacttacattcaaaacccgccgttctttgaggaaatgtctgtagagcctggaaaagttgagcctttaagaggacttcgcgttgtcggcaaattcggcgattccgtgacgactgaccacatttctccggccggagcgatcggaaaagacacaccggcgggcaaatacctgcaggaaaaaggcgtttctcctcgtgactttaactcttacggctcacgccgcggaaaccatgaagtcatgatgagaggaacattcgccaatatccgcattaaaaaccaaatcgcaccgggtacagaaggcggatacacaacacattggcctaccgggaaagtgacatctatttatgatgcctgcatgcggtataaagaagataaaacgggtcttgtcgtcctggccggaaaagattacggaatgggctcttcacgtgactgggctgcaaaaggaacaaacctgctcggcatcagaacagtcattgccgaaagctttgaaagaattcacagaagcaacctcgtcttcatgggtgtgctgccgctccagttcaaacagggtgaaaacgcggatacactcggcttaacaggtaaggaagtcattgaggtggatgttgatgaatctgtacgtccgcgcgacttgctgactgtcagagcaatcagtgaagacggtacggtaaaaacgtttgaagtcgttgtccgtttcgacagtgaagtggaaattgattactatcgccacggcggcattttacaaatggtgcttcgcgataaaatgaaacagtagcagaatgaacaaaggagagaaagcagtctgctttctctctttttatgcgggaggccttaagatgcttgcgaaatggctgggcggaatgttacttatcgggttgttagtgtatgcgggctggaatatttattctgtgcaaaaaagtccgaaagaagggacagaagaagggatgaaagcccctgactttacacttgatacattgtcaggaaaaagcatctccctttctgattataaaggaaaaaaagtgctcctcaatttctgggcgacgtggtgcaagccgtgcagaatggaaatgcccgatatgcaggagctgcagaaagaatatcctgatattgcggtagcagccgttaattttacatcctctgaaaaaaatatacaggctgtgaaatcatttgctgatcattatcagctgacctttcctattctgattgacaaaagcggaattaacggggatttcaacgtgctttcttatccgacaacatacatattagacgaaaaaggaaccattcagcacattcgcgtaggcacgatgacaaaaaaagaaatgaaagaaaaactggatctcaaatagaggttcagtttttttattgtaaagggcttaggttttgaaaaattggaaaaaatgaatgaaaacacggaggtgagaagattgaaaaaaatgcgaaaacgttcttttcatgaattggttatggaaaataaacgtgagctgatgaccaatacggaatatttgaatcagcttgaagaaaagctggagcagcggttcaaacaaaaataacctttaatttgcagtcatgtttacacctccttttgcaaaatatactcttaaggagggatgaacatgggcataaacaagaaagacggccagccgcaatacgctccgagccacttagggacaaaacccgttaaatataaacgcaataaaggggaaaagtttcatgacaagtcaaacggacatccgattgtcatgcagacgaaaggcgaataacatcatcaaaggagagcagatattatgacaaacaatgatcaaaaaccgaatccggatgaccgttccgataacgttgaaaagctgcaggatatggtgcagaatacaattgaaaatatagaagaagcgaaagaatcaatggaatttgcgacagatgaggaaaaacagcgcattcaagagaagaatgccagacgcaatgaaagcattgaatcgttccgcagtgaaattcaggatgaatcggctgcaagagaaaacggctatcaatcataataaaaaccagggaaacctggtttttttctctttccggctcgttgtgataaaatggggctaatctgataaaaagggagcagagaacgttgcatgtgtcaaaaaaagaaatagaagtgcgttatgcggaaacagatcaaatgggcatcgtctatcatgccaattacttagtctggatggaggtcggcagaacggcgctgattaaggaactcggattcctttacaaagatatggaagatagaggagtgctgtcccctgtattggatatcagcatttcttataaaaagccgctccgctacggagaaacggctgtcgtacatacttggattgaagaatataacggatttaaaaccgtttacggctaccacatctataatccggatcaagaacttgccatcaaagcgacatcctctcatatatgcgttgataaagagagcttcaaaccgattcagtttcgcaaggcttttcctgattggcatgccgcttacgaaaaggcaaaaaaataaggagcggctgcagttatggcatttggaattacgcgtaaggaactggaaagatggaagcgggatgtatcggaagggaaaatcgcttttttaacgcattactggctggacgaccgctttccggaggctaagaccgtgacgaaggccggttcaagcgatctcaataaactgatcagatggggagcggagtacgggctgaagccggagtggattcaccataaaaatgaatttccccactttgacctgctcggagaaacgcaaagaagcatattagaaaaagaacgtctgactgatcatctcaaaaggttcaggctgtaaaaaaaagaacgcatccgctgcgttcttttttttacacgtaatcaaataccggctcttctgcctgatctgaatatgtgactgacaaatcgtgattatcaaagtaccataagtcgctttcttcaataaaaaaggtaatgccttcaacttccgtgctggtgccgatgttcatcggccggtcttttaaaatgccgagagaaaagcctttctgaacgttgctgcatcccccgtaacggacaaagaaacggacatggtcgcctgtttccagatcgagctcttctttgtaccaatccagcgcgcctttcgttactttcatgttcatccggaacactccctttttgtttctcatataaagaaattatctctattataaacgcatatggcattttgatgtcaaaattgaagtttcatcaaaaccatttgatcttcggttctgttttgtttataatccgtttgatgtttgccctgtgtctgtagataacaaacgcggtcaagagcgtcactacgattaataaataagggtcttttacaaacagacagtaaataatcgtataaatccctgttaacattgaagacagagaaacaaatttcgtaaggaataaaaatacgaaaaatactgcaaccatcgtaacgaataacagcggagcataaaacagcaggacgccccctgatgtggctacggctttgcctcctttaaactttgcgaacaccgggaatacatggccgatcactgctgccacccctgcgagaagaggatgaatggggacgtgcagtaaatatgggagcgccgcggccagggtgccttttaaaatatcggctgcgacgacgacagatcccgctttaacgccaagcgtgcgaaaagcatttgtagcgcccaaattgccgcttccgtgttctctaatatcgatccctttcgcaagtttgcctacgactaaacctgacgggatgctgcctattacataggccaaaataatcaataaagcaatcaacatctacatttctccttttcaatgtcccttcactctattttaacacgagttgttaccgtctgatgacaagttttttgagaattaagctgacaaagcgctttttttgattccggcgaagcggtcatgtacaatatatcaaaaggagatggtaaagatgcaaaatccttcaaaatcagagattaaagaaattctggaccggagcaaacggatcgcagtcgtcgggctgtcagaccgtcccgaccggacttcttacatggtttccaaagcgatgcaggatgaagggtatgaaattattcccgtcaacccaacgattgatgaggcgcttggcgttaaagccgttgcttcgttaaaagacgtggaggggccgattgatatcgtgaatgtgttcagacgctctgagcagcttcccggcgttgctgaagaatttttacagacggacgctcccgttttttgggcgcagcagggccttgcaaatgaagaagcgtatcgcatgattacagacaaaggacggacggctgttatggatttatgtataaaagtcgcccgcgctgttataaaataggaacaaaaaaggcaaaaatccttggcaaatcaggggtttttgcttttttattgaaagaatactctttgcgtatgatgatgaaacagatacaataaagcatgaacagcttttttagaaacccctttatacaggggtttgcagtctgtttgcgatggccggcataaagctatataatagaaagcgaactcatgttcttatctgccgaaaagggcaccaaaaagatgaaaagccgttcgaatgtatgtcttgcggcctaaaaaacgagccattcgcttaaatatgttgcgaaatcaagcatattggttataattgtgagtccgaggagaattggaccgaagcttgcgcatactgaaaaacaaagacatgaaaacatttaaaaaagagaatgattaagagcaggttttttgaaaggggtttgtacgtttggctagaaaacagcaatttgattacaacgaagatgccatacaggtgcttgaaggcctggaagccgtcagaaaacgaccgggaatgtacatcggttcgacggacgcacgcggcctgcaccatctggtatatgagatcgtcgacaattccgtcgatgaagttcttgccggctacggagatcatattatcgtaacgatacataaggacaacagcatctccgtacaggacagaggacgcggaatgccgaccgggatgcataagctcggaaagccgacgccggaagttattttcaccgtgctgcatgccggggggaaattcggacagggcggctataaaacaagcggcggtctgcatggtgtcggcgcatctgtcgtaaacgcgttatcggagtggctgacagttactattgagcgtgacggatatgtttataaacagcgatttgaaaacggcggcaagcccgtgacttcacttgaaaaaatcggaacgaccaaaaaaacgggaacgcttacccattttaaacctgatccgtcaatgttcagcgcaacggtttataattttgacacgctgtcagaacgtctgcgcgaatcagctttcttgttaaaaggtttgaaaatagaattaattgatgaacggaacggcgtaaaagaagtattttattatgagaacggaattgaagcatttgtcgcttatttaaacgaggaaaaagacgctttatgcgaagtggtttcctttgaaggcgagcatcatgacattgaagtcgatttcgcgtttcagtttaatgacgggtattcagaaaatatgctgtcattcgttaataacgtcagaacaaaggacggcggcacccacgaatcaggagccaaaacggcaatgacaagagcgtttaacgagtatgcgcgaaaggttgcccttttaaaagagaaagacaagaaccttgaaggcgccgatatcagggaaggtttgtccgcaatcatttccgtgcgtatcccggaggaactgctgcaatttgaaggccagacgaaagggaagcttggcacaagtgaggcgagatcagccgcggatgccgtcatttccgagaatcttgcttatttcctggaagaaaaccgcgatacggcgaccctgcttgtcaaaaaagtgattaaagcaagccaggcccgtgaagcggcccgtaaagcgagagaagaagcgagaagcggcaaaaagcgaaaaaaatcagaagcgacgctgagcggaaaactcacaccggccggttccagaaatccggcgaagaatgaattgtatctggtggagggagactctgcgggaggttctgcaaaacagggaagagaccggaaatttcaagccgtgctgccccttcgcggaaaggtcatcaacacagagaaagcaaagcttgcagacatcttcaaaaatgaagaaatcaatacgattattcatgcgatcggcggcggtgtcggcgcagattttgatatagacgacatcaactatgacaagatcatcatcatgacggacgcggataccgacggcgcgcacattcaagtcttgctgttaacgtttttctaccgctatatgaaacctttaatcgagcacggaaaagtcttcatcgcccttccgcctctttacaaagtgagcaaagggagcggtaagaaagagattattgaatatgcctggtccgacgaagaaatggacggcgttttaaagaaagtcggcaaagggtataccatccagcgctataaaggtctgggagaaatgaacgcagaccagctctgggaaacgacgatgaatcccgaatcgcgaacgctcgtcagagtcaagatcgacgatgcggcacgggtagagcgccgcgtaacgacattaatgggagacaaagtagaaccgagaagaaaatggattgaaaagaatgttgccttcggattagatgaggaaagcaatattttggaaaatgaaaacttgtcggtcgctgaggaggtttaatagtggcacagccagaattatttcatgatttaccgttagaagaagtaatcggcgaccgtttcggacgctacagtaaatacattattcaagacagggcgctgcccgacgctcgtgacggtttaaagccggtgcagcggagaattttatacgccatgcacgcagacggaaatacattcgataaaaatttccgtaaagcggcgaaaacggtcggaaacgttatcggtaattatcatccgcacggtgacagctccgtttatgaagcgatggtgcggatgagccaggattggaaagtgcggaatgtgctgattgagatgcacggcaacaacggaagcattgacggtgatccgccggctgccatgcgttatacggaagcgagattatcttctatcgcgtcagagcttttgcgtgatattgataaaaatacggttgaattcgttccgaactttgatgacaccagtaaagagccggttgttttgcccgccatgttccctaacttgcttgttaacggatcaaccgggatttcagcgggctatgcgactgatattccccctcatcatctgggtgaggtcattgatgccgtcattaaacggattgaatctccggattgcaccgtcgatgacttgatgcaggtgattaaagggcctgactttccgacaggaggcattattcaaggagtcgacggcattcggaaggcttatgaaaccggtaaaggcaaaattattatccgcggcaaggctgaagtggaatccgtaagaggcggacgggagcagatcgtcattacagaaattccgtttgaagtaaacaaagccaatctcgttaagaaaatggacgaataccgcatagacaaaaaagtcgaaggcatttctgaagtcagggatgaaactgaccgcacggggcttcgggtggtcgttgagttaaagaaagaagccgatgcaaaaggcatcctgaatttcttatataaaaacactgatctgcagacaacatataactttaatatggtcgccatacataaccgccggccgatgctgatgagtcttacggccatcctggatgcgtatatttcccatcagaaggaagtggtgacaaaccgctccgtctttgaattgcaaaaagcaaaagagcggcatcacatcgttgaaggactgatgaaggcgctgtctgtgttagatgaggtcatagcggtcatccgggcaagcagcgacaagaaagatgcgaaacaaaacttaatttctaaattcgcatttacggagcctcaggccgaagcaatcgtatccttgcagctgtatcgtctgacaaacacggatattacggcgctaaaagaggaagcggaagagctcagcaagaaaattcaggagctcgaagccattttaagtcatgataaaaagctgttaaaagtcattacaagcagcctgaaaaaattgaaaaagacctatgctgacagcagacggtctgtcattgaagaaaagattgaggaaattaaaatcaatcttgaagtcatggttgcctctgaggacgtatatgtgacagtcacaaaagacggctatgtaaaacgaacaagccagcggtcatttgccgcttctaacggccaggatttcggtatgaaggatactgacaggctgattcaccaatttgaaatgaatacaacggatgttctcctgctctttaccaataagggaagctatgtttattgtccggttcaccagcttcccgatatcaggtggaaagacatggggcagcacgtaacgaacatcatcacgattgaccgtgatgaaaccatcgtgaaagctataccggtaaaagaatttgatccatcttcatatttattgtttatgacgaaaaacggcatggtgaagagaactgaaatgacgcattacaaagcgcagcgttactcgaaagcgcttgttgcccttaaccttaaaggggacgacgagctgattgatgttcatgtcacagacggcggcagccagctgtttatcgccacccgcctcgggtacggtttatggttcggtgaagatgaagtaaatgtagtcggtgcccgtgcggccggcgtaaagggtataaatttaaaagacggtgataccgtcgtatcaggacaaatcctgcatgagacagattcgcttatccttgtcacacagcggggagcaatcaagcggatgaacctatctgaattcgaaaaaacatccagagcgaagcgcggcgtcatcatgctgcgtgagcttaaaaagaacccgcatcgcacagtcggcgtattcgcatgcgctttggccgacatgatcgctgcggaaacagaaaaaggcgagagaatcgaaatcgccgtgaagtccttgcgggcgaatgaccgatacagcaacggttccttctttaccgatgaagctgagacagggccggtaacagatgtatggcgtatccccgcgtctgatgtttaagtttaagagtaaaaataaaataaaaaaaacctccgctcattgagcggaggttttactatttagctttcgtggctgccgaataagtcagtgatagcgtgaatgacttcgattccctgccatacaaataaattcaatgcagtgaatgaaaacaaccctaaaatcaccattcgtaagataaacaacatgtttaacaacctcctcattttatgttacatagataggcgatgttgaacatgaagctcatcgaaatacgaggactgataaaatttagcgattaaaaagcttttctttcgctgtcttctccgggaagcggggcgtctcctgtctgatatcacgatcagtgagacagaagcggcaaaaagcgccgtcaagatatatgagcccgtcagcgattttttctcatcatcagcattttggccggccttcatttcgtgcatttcctgctggtcggctaccgctttaaaatgatgagaagtatcaaacgcatggggaatggagagcaaatgaaagcttgcaatcgctaaaaataaaatagaagcttttaaaaacaagatttttttcaaatgttctcccccccttcataagtctgaatatttttattataataccctaatttaaatgtaaagtaaacatatttattaaatttaaaaaattattatcctggttaagtatataccattccatccatcttttcatctcttttatcttaaagacctatttgttatgatatgcacgcattccttatgacgtgacaacatttttcgggctgtaagataaaaaacggggcatgacagcaaaagacgtgatgaagaaaccgaaacattttcttaaaaaaacttctcaaccacggtcgttgtgatataataatactcgttgtgttaaaagatctaacatatgcagcaaaaatgacagtaaaagatacgtaaaagggaggttaaacatggaggctttcatcagtgaaatcataaatgttccaaatgattttatttggaagtatcttgtttatattttagtcgggatcggattgtactttacgttccgttttcgctttattcaattccaatactttattgaaatgttcagaatcgtcggggagaagccgcaaggaaataaaggagtgtcttcaatgcaggcattctttatctcagccgcttctcgtgtcggaaccggaaacttgaccggcgtcgcgctggcgattgcaacaggcggtcccggcgcagtattttggatgtggatcgtagcgattgtcggtatggcttccagctttgtggaaagcaccttggcgcagctgtataaagtgcgttccggtgacgaattccgcggcggtccggcatattacatggcaaagggactgggcgcccgctggctcggtattttattcgccgtattgattaccgtttctttcggacttatctttaacgccgtgcagtcaaatacgatttctgtcgcgtttgacgaagcattccatgtgaataaaacagttatcgcaatcattttagctgtattaacggctttcattatattcggcggtctgaaacgtgttgtttccgtctcgcaattaatcgttccggtcatggcgggtatgtatattctgatcgcgctgtatgtcgtgattgtaaatattacagcggtacctgagctgtttgttacgattgtgaaaaatgcgttcggtcttgaacagatcgtcggcggaagcttaggaagcatcattattatcggtgcgcagcgcggcctgttttcaaacgaagcgggtatgggaagcgcgccgaatgccgcagcggctgcacatgtgtcgcatccggctaagcagggattaattcagaccctcggtgtgttttttgatacatttatcgtttgtacatcgactgcctttatcattttattgtacagctttacgcctaaaggcgacggcatccaagtgacacaagccgcactgcagcaccacctcggcggatgggcgccgacatttattgcgattgcgatgtttttattcgcattcagctcagtcgtcggcaactattactatggtgaaacgaatattgaatttattaaaacaagcaaaacatggcttaatatttaccgcgtattcgtcgtagtgatggtggtatacggatgtttggctgacttccagatcgtctgggacatggcaaacttgtttatgggactcttggctctcattaacttagtggcaatcttattgctgagtaatgtagcctacaagatctataaggattatgccgctcagcgcaaaaaaggtcttgatcctgtattcaaggccgagaatacgccggagctcaagcatattgaaacatgggcgaaagaagaaggtacaagccccgaacgtaagactgctaactaaggaaacatgcatacaattttcaaaaaaccccttacattttgttggcttctctcgaagcgacctcttaatcataacattttcagtttgctaggtcaatactttttttaaaaaatattttcgataggcttgcctttctattaaaaagacaacaaaaagaattatatcagtatcatcgctatgtgtcaaagctttttttcatttctttatatagtaaaagcgcagcctgttacagctgcgcttttcgtttatacttcttccgtttcttccggctcttcttcattcttttccacaagcgccacagtggctacatgctcttgatcagacatgcggatcagacggacgccttgtgttacgcgtcccgtagtggaaatatcattaatatccattctgattaacacgccgcttgccgtaataatcattaagtcctcttcgccttttgttgctttcacggttactaacggaccgttgctgtcagtgattttacatgttttaaggccttttccgccccggctttgaactctgtattctgaagccggtgtgcgtttgccgtagccgttttctgtcactatgaggacgtgggagtcttcttcaagaatctccatgcctacaacgacatcatcgtctgtcagcgtgatgcctttaacacccgcagctgtgcgtcccatttgtcttacatcttcttcagggaaacggatcagcaaaccgttcttcgttccgatgatgatttgtttcttgccgtcagtcaggcggacggccatcagttcatcgtcttcccggagacccagggcgatcagcccgttattccgtatattcgcaaactgggacagtgccgtacgtttcgacaccccttgtttggtcgtaaagaagaggtattgctcctcatcaaaagtgctgaccggaataatagcattaatccattcgcctttttcaacctccagaaggttaataatcggaatgccttttgccgtacggccgtattcagggatttcatatcctttagaacggtatactttccctttattagagaagaacaggatcgtatcgtgcgttgatgtggaaattaagtgttccacaaagtcatcttcattcgttcccattccctgtacgccttttccgccccgtttttggctgcggtatgtggacgccgggagacgtttaacatagccgttatgggtcagtgtgatgacgatgttttctctctcgataagatcttcatcttcaattgtttcaagaccggacgtcacgatttcagtgcgtctctcatcattgaaacgctctttgatttcattgagctcttcacggatgatttcaagaactctttcttcattggctaaaatatctttcagctcggcgataagcgcaacaagtgattgatattcctcttcaatcttttcgcgctccagaccggttaatcgctgaaggcgcatatccagaatggcttgcgcttgtttttcagtcagtgagaattgttcgatcaaacccgttctcgcaatttcagccgtctgggaactgcggataagagaaataacggcatctaaatgatcgagagcaattcttaaaccttccagaatgtgagctctcgcttccgctttgcggagttcgtaagccgttctgcgccggatcacaaccttttggtgatcaagataatgctccagacattgtttcaggctcagcaccttcggctgtccgtcaacgagcgccagcaggttgattccgaaagacgtctgcagggccgtttgtttgtacaggttattcaaaatgacgtgagcattggcgtcacggcggatctcaatgacgattctcattccgttacggtcggattcgtctcgcaggtcggtaattccttcgatttttttgtctcggacaagatctgcgattttttcaattaatctcgctttgttcacctgataaggaagttccgtaacaataattctttcttttcctgatgatgtctcttcgatttcagccttagcccggattgtgattgatccccgtccggattcatatgccttgcggatgccgctccggcccaaaatctgaccagcagtcggaaaatccgggcccggaatgtattccatcagctcctggtttgtaatctcaggattctcacttacggcaagcacgccttcaatgacttccccaagctgatgcggaggaatatttgtcgccattccgaccgcaataccggcagctccgtttacgagcagattcggaaatctcgaaggcatgacgacaggttctctttctgcgccgtcatagttatcttgataatcaatcgtatctttcgtaatgtcacgcagaatttccattgcgatttttgacattctcgcttctgtgtaacgcatcgcggccgctgagtcgccgtcaaccgaaccgaagttgccgtgtccgtcaacaagcatgtagcggtagttaaaatcctgcgccattctgaccattgattcgtaaaccgctgagtcaccgtgcgggtggtacttaccgataacttcaccgacgatacgggcagattttttatatggtttgtcactggtcatgcctaaatcattcattgcgtacaaaatccgcctgtgaaccggcttcagaccgtcacgcacatccggaagcgcccgggatacgataacgctcattgcatagtccagaaaggatgtccgcatttcctgactgatattgacttcacgtacttgtggtgtgttttgttcactcattaaaaaaacctccctgaagtatcacatgaaataatgtgggagtagattgtccattatgatcttcaatacgatttcactattctccattatatcaataaacttgtgtttatacacattaatttagtagaatatacgggttttgcgggttttcagaggctttagaagccgctttgagaaaaaagccttatttcttaacgaaaataaggctttcttggttaaatatcaagatttttcacgtatctggcgtttgcttctatgaagtttctccgcggttctactttgtcacccatcagcatttcaaaagtctcgtcagcgtccattgcatcttcaagattgacttgcagaagcgttctggtcgcagggtccattgtcgtttcccaaagctgagtcgcgttcatttctccaagacctttataacgctggaggccgggcttaggcgattgcggaagctcttttaacagctcatcaagctgcttatcgttataagcgtattccacccgttttccctgctgcactttataaagcggcggctgggcaatgtagacatagccgttttcgatgatttcccgcatgtatctgtagaagaacgttaataaaagcgttctgatgtgggcgccgtcaacatcggcatccgtcatgatgaccactttatgataacgcgctttttcaagattaaaatcttcgccgattcctgttccgagggccgtgatcattgatctgacctcattgtttgagagaatcttatcaagtctggctttctcaacgttcagaatcttaccgcgcagcggcagaatggcttggaaatgacggtcccgtccctgtttcgctgatccgcccgcagagtcaccctctacgatatacagctcggaaatgctcggatctttagaagaacagtccgccagtttgcccggcagattggaaatctcaagcgcacttttgcgccgggtcaattcccgcgcttttttcgctgccatccgcgctcttgcggccattaaacctttttcaacgattttgcgggctgagtccggattttcaagaaggaatgtttccagcgcagaagaaaacagcgtgtcagtgatcgttctcgcttcagagttgccgagcttggttttcgtctgcccttcgaattgcggatcagggtgcttaattgaaataatggcagtcagcccttctctcacatcatccccgcttaaattcggatcattttctttgaaaatcccttttcttcttgcatagtcgtttatgacacgggtcagaccggttttaaatccggcctcgtgcgtcccgccttcgtatgtgttgatattatttgtgaaagaataaatattgcttgtatagctgtcgttgtattgcaatgcaacttcaaccgttatgccgtctttctcgccttcgatataaatcggctcttcatgaacgacttctttggaacggtttaagtactcaacatagcttttgattccgccttcgtagtggtactcgtttttccgttcttgtccttcacgtttgtcttcaatcgtgatgtttacgccttttgtcaggaaggccaattcccggacacggtttgaaagcagatcatagtcgtatacagttgtttctttgaagatttccggatccggaacgaagtgcgtaatcgttccggtcttatcagtatcaccgatcacttcaagatcggccacaggcacaccgcgctcgtacgcctgatagtggatttttccgtcacgatgaaccgtaacgtcaagagtggtcgacaaggcgtttacgacggacgcccctacaccgtgaagaccgccggatactttatatccgcttccgtcaaatttaccgccggcgtggagaacggtcatgatgacttcaaccgcagggcggcccatcttctcctggataccgaccggaattccgcgcccgttgtccttaacggtaatgctgttatctttttcaatctcgatattaatatctgtacaataaccggccagggcctcgtcaatactgttgtcgacgatttcccacaccaagtggtgaaggcctttgctgttagttgatccgatgtacatccccggtctctttcgaacagcttccaaaccttctaatacctgtatctgattctcatcataactattttgctgctgttccatagccatgcacattcacctacacttttcttaaacgatatattcattgtaaagatccgctaagaatctatttctaacataaattgcgcacgtttcttcagtgtgccggaagataagggagagtaatatatattctcagtcgtgactacgatagactttggcgtgccgtttacggacggcactactttttctttctgtctgtccagaaattcttcaacaatcggcgatacattgaccttgcagtcaaaaatgccgacgatatcgcgtgttgaaacgacaaagtcgtcacctaaatgaatatacaatcgctcacctcatttcttcacttcactaacgtaccgttttccacacggaacattcctgcttgatgtaaggtatcgtggtcaatgccatccacgcttgtcgtggtgacaaatgtctgcacacggccttggatcgtatgaagcaaatgggactgtcggtaatcatccagctcgcttagtacatcatccaaaagtaaaatggggtattctccgatttcttcatgaatcaaatctatttcggccagcttcaaagacaaagccgtcgtacgctgctgtccctgcgaaccgtacgtctgcacatcgcgtccgttcacataaaaaaggacatcatcccgatgcggtccgaataatgtgacgcctcgttctatttctttttcttttaatttcgaaaaagactcctggtagctgttacctattttcgacaaatttttgggatctgatacatcaagcgccgtgtgatacttaagcgtcagttcttcaagtccccgggaaatgccggaatggatcggctgcgcccatttttcaagctgcgccgtaaactgcagacgtttggcgacaacttttgcggctgcttcaatcagctgatcagtgagaacgtcaagcatggtccggtcagtctgtttccggctttgcagctgtttcagaaaatgattccgctgtgaaaggattttttgataaagagataaatcatacagataaacggcagaaacctgcccgatctccatatcgagaaatctcctcctcacctgagggcttcctttgacgagatttaaatcctcaggggcaaacataatggtgttcagcgctccgacatactgactgagtttttgctgctctatatgattgaccttgccctttttaccttttttggagatgacaagctgcatcgggatgtccccgttgcgcttcatcactcttccttctattttagcatagtcttcgtcccaccgtataagttctttgtcatttgaggtgcggtgtgattttgccatcgaaaggacatagatggcttccatcagattggttttgccttgggcattttccccgatgatcacattcaccttgttttcgaattgaagctcagcgcgctcataattacggtaggatgttaattctaaattttggatatacaaccgctgtcacccgctttaattgacgacttgaaatgaaccaaatccttcaatcgcgaccacgtctccaacgtaaagctttctgccgcggcgattgtcaggttcattgttgacagtcacctcatgctcgctcagaaaccatttcgccatgccgccggactgaattacatcggctaattttaaaaactggccaagcgtaatcatttctgtatcaatcgaaatcggatttgccataatatcgacctctttcaaatatcactaatatctaattgtactaaaaaatcctgaaataaggaaagggaaaacttgagggagcggctgatgaatagaaaagctgccgaactaagccggcagcacattctgtttgattaatacgttctgaccggaaggatgagctgaacgatggtttcatcattcggcgtacggataagaaacggtctcatcgctcccgtaaagctgatacggatgtccgctccttcaagtactttcagtgcgtccatcatatattttggactgaatgaaatatttaattcctcgccgtcaatctggtcagccagcacagcttcgaccacttttccgatttccggagaatttgatgaaatttcaagcgaatccgccggtttggcagaaagctttacaacgttgttgcggccttctctcgccaataaagaagcacggtctatcgcctgtaaaaattccttcgtgttcacgacgatttccgttttgctttcctgcggaattaagctggtcgtgtccggatagtttccgtcaagcaatcttgagaagaacaatacgtttttcgctttgaacagcacttgggtttctgtaatcacgatatcaaccagttcttggttgtcatcaagaattttgctcagctcggttaagcttttcccgggaatgaccacgttataagagctgtcttccggaatatcaagcttcgcctttcttaaagcgagtcggtggctatccgtggcagtgcataataattcaccgttttcgactttccagtttacacctgtcaagatagggcgtgtttctgaggcggacacagcgaacacggtttggcggatcaggtttttcaaaagatccgtcggaatctgaatggcgtgatgctcttcgatttgcggtagatgcggatattcatctgcatcaaggccgtttaaattaaattcggcttttccggaacggataatcgttaaatattgattttgaacttcgatttcaacagtcgccatcggcagttttttaacgatttcgctgaagaaacgcgcttgcagcacgatacttcccggctgatcgatcgtcacgatttctttatcatcatcttctttcggaatgaatgactcaattgaaatatcagagtcacttcctgtgaaagatactccttcatctgaggcgacgatcttaataccggtgagaatgggaattgtggttctggatgaaacggcttttagaacgtcttgtacactttcgactaaccgatctttttgaatcgtaaatttcatgtttatcctcctaacggataatataattaatatattttaaaatagcagtagtaatagtagggcctgtggatttgtggataagttgtgaaaaagacaggaaacacagcctatccacatgtggacagactgtgcatggctatgaaaaagttattcacactttccccgattcatccgagggcactattatttaagcagttcttttatttctttcacctgctgctgaagctgctcgtcatcaatcagcagttttgaaatcttttcgtgggcgtgaatgacggttgtatggtctctcccgccaaattcttccccgattttaggcaaagaagaatccgtcatttctcttgaaagatacatcgcaatttgtcttgggaaagccactgatttcgtacgctttttcgctttgaaatcttcaagcttaatgttgaactgctgtccgacaatccgctgaatctcttttatcgtaatgaccttcggcttagaagacggaataatatctttcaatgcttctgctgccaggtctgcgttaatgtctttattgattaaggatgaataggcgacaacccggattaatgccccttccagttcgcggatgttgctgtcaatctgattcgcgatgtaaagcatgacctcgttcggaatatcaaggccttccgccttcgctttttttctcaggatggcaatccgcgtttccagatccggcggtgtgatatctgtaatcaatccccattcgaaccgcgaacgcaggcggtcttcaagggtcgggatctctttcggcggtctgtcactggaaatcacgatttgtttgctttcttcatgaagcgtgttgaatgtatggaaaaactcttcctgtgtttgttcttttccggctaaaaattgaatatcatctatcaaaagtacatcaacgttccggtagcggttgcggaaatcaacggctttattatcgcggattgagttgatgaattcatttgtgaatttttcagaagacaggtacaccactttggctgaaggattatgatcaatgacataatggccgatcgcgtgcattaagtgggtttttcctaagccgactcccccgtatataaataaagggttgtacgctttagcgggtgcttccgccacagccagtgatgctgcatgggcgaatcggtttcccgatccgatgacgaatgtgtcgaatgtatatttcgggttgagcatgctttggggaaaatcagacggttcctcttttgccgcttttttcacttgcggtttcggtaaaaagtcttcttcgtcctgattttgaggaatgacaaatttgacgctcaattcttccccggttaattcatatatggtatctgcaatgagatgtaagtacctggactccagccagtctctggcaaattcattaggagcggtgatggttaaggtatctccttgcagcgaatgggctttcgtcgacttcatccaagtttcgaaactcggtttgcttagctttttctcaatttgagctagagcttgattccaaagatccaatatattctccattatccggcacagccctccttttctttaaaaatcagcgccctttccctgttatagaacacaaaaaaagagcatatggctctgaccattcgtacacacgaaatgttgaaaacatatagtatagtagaaaaatagcttttcgacaaattccacaagttgtggacaacaatctacacaagctgtgtgaaaacaatccacaacttatccacaaattgtggataaggagaatggactggataagtaattaagagttaaaacacaaatataatatcaaattaagcgaggacttgcaatggttctcgtaatcttatccacaaacctgacaacttgttgaaaaatctttgtccacaggggttagcaatgtgaaaatgttgtcgataacgattgtggatattaaaaaaaaaccgaaaaattatccacatgacgttttttcgggggagcgcggctttttttgtgcgttaaaaaaaggaatatgaaaaataaggtttctaatctggttaaggtatgttatcctattatggttgtaagaaataaaagcactgctgaagttgacaatgaataggcagcacaaatataataagtaagactgtctttaacagctattcctcgagggaggtgtcataaatgaaaagaacattccaaccgaataaccgtaaacgcagtaaagttcatggcttcagaagccgtatgagttcaaaaaacggtcgtctagtattagcacgccgtcgccgcaaaggcagaaaagtattatcagcttaggccactgaataatgtcagtggtcttttttcacattaagagagtgagatgtcatgcgtcgcccggtactggagaaatttcttcagtattccggcggcccgttttttttagatagaaataaaagtttctgcgagtgaatatcggagtgaattaaagtgaagaagcgaaatcggttaaagaaaaatgaagattttcaaaaagtgtttaaacgcggaacgtctatggcaaaccgccagttcgtgctgtatacgcttgatcagccgaaacaggaagagctccgggtagggctttctgtcagtaaaaaaatcggcaatgccgtcgtgcgcaatcgggtgaagcggttaatcagacaggctgttcaggaggaaaaagagctgctcaagccgaaagattttattattatcgcaagaaaacccgccggcgacctcagttttgaagaaacgaaaaagagtctgcagcacttattcagaaaaacctcattatataagaaatcttcgtcaaaatagctcatattttgttttcttcacgtttttaaaagcgcttccttttatttggcgaaaaatgaacgccatttgaaactgaaagatgctaaaatacatacaaggtttataaagattggtataggaggaaacgttcttgaaaaggagaatatggttactactgagtatggtcggtatgctcgtgctgctggccgggtgctcgagtgtgaaagagccgattacggcgaatagtccgcatttctgggacaaatatgttgtgtatccattgtcagaagtcattacgtacgtagcgaaactgacgggcgataactatggtttatcgatcatcatcgttacgattttaattcgtctgctgattctgccgctgatgatcaagcagcttcgaagctcaaaagcgatgcaggcgctgcagcctgaaatgcagaagctcagagaaaaatacagctctaaagatcaaaaaacgcagcagaagcttcagcaggaaacaatggccctgttttcaaagcacggggtaaacccgctggcgggatgtttcccgatcctgattcaaatgccgattttgatcggattctaccacgccattatgcgtacgcaagccatttcacagcacagctttttatggtttgacctaggagagaaggatccttactatattcttcctatcgttgccggtgtggccacttttgtccagcagaagctgatgatggccggaaatccgactcagaatcctcaaatggcaatgatggtatggattatgccgatcatgatcatcgtatttgcgatcaacttcccgagcgcactttctctgtattgggtagtcggaaacctgtttatgattgctcagacattccttattaaaggacctgacattaaacacgatccggaaacgcagaaagcgggaggaaagaaaaagtgaagaaggtgactgctgcgggacggaatgtcgaagaagcagttcaatcaggccttcaggaacttcaactgacgaaagatcaagtagaaataacggtggtgcaagaagaatataaagggtttttgggtatttttggaaaaaagaatgcgatcgtagaactggaagagaaaagaaatcctgttcaggaagcgaaagcgtatttggaagaaatcatccattccattgccggaccttctgagattgttacggaagaaaacaagaaaacagtctgttttcacattaaaggtgaaaaagcggcgctgcttattggcaaaagaggacaaacactcaatgccctggaaacattgacgcagcttgttttgaaccgcggctccggccagtatcgccaagccgttgtcgacgctgagaattatcggcggaaaagaagagaaattctggatcagctggcaaacaggctggccaagcaagtctcgaaaacgaaaaaagatgtgcatttagaaccgatgccgtcaggtgaaagaaaaatcatccatgacgcgctgtcaaagcatccaaatatcaaaacgttttctaccggtgaaggccggtaccgccatctcgttatttcccataaagatagcagaaaaccgaagtccgggtaaaatcggaacttcggtttttttattggtaaaaatggctctattcctaagcagaatcgcatttttagcgtttaagttttttctttttcggtctatgctgttgataaaaaaggttttaggaaataaaattaattgttattcacatgtggataagttaaagtaataagggatgaatttctgcctttgtggataacgtatcttccacttcaaaccaaactatgttatcttttaattttggcgtaaataaaattttttatatagatggaaacagagataaagagaggtgaacagcatggatacaattgcagcgatttcaactccgatgggtgaaggcgcgatcgcgatcgttcggctgagcggcccggaagccgtaaaaattgccgacaaaatgtacaagggtccgaaaggcaaaacgctcagttcggcagaatcgcataccattcattacgggcatatcgcggacagcacgacgggacggattattgaggaagtcatggtgtctgttttaagagcgcccagaacattcacaagggaagatgtcattgaaatcaactgtcacgggggtattgtgacggttaatcaggtgctccagcttgctttaagagaaggtgcgagactggcagaacccggtgagtttacgaagcgcgcatttttaaacggacggattgacctatcacaggcggaagcggtgatggatctgatcagggccaaaacggaccgtgccatgaatgtcgccatgaaccagatggaaggacggctttctgcgcttgtccgccgtctgcgtgatgagctgttagaaacacttgcacatgttgaggttaatatagattatccggaatatgatgacgtcgaagaaatgacgcatcagcttttagtggagaaggcaagcggcgtgaagaaagaaatcgaggcgctgctccgtacgtctgagcaggggaaaattttgcgtgagggactgtctaccgtgatcatcggccgtccgaacgtcggaaaatcctctctgcttaacagccttgtccatgaaacgaaggcgatcgtaaccgatattccgggaacgacgcgtgatgtgattgaggaatatgtcaacgtgcgaggcgtgccgcttcggcttgtcgataccgccggaatccgtgagacagaagatatcgtcgaaagaatcggtgtggaacggtcacggcaggttctgaaggaagcggatctcattttgcttgtgcttaaccacagcgaagcgctttctgaagaagatgtgaaattgtttgaagcggttgagggaatggacgtcattgtcattatgaataagacggaccttgaggctaagattgacgctgagcgcgtcaaggaactggcgaaaggccggcctgtcgtcacgacctcattgctgaaagaagaaggcattcaagatttagaggaagcgattcagtcgctattttatacaggagcgatcgaaagcggagatctcacctatgtcagcaacacccgtcatatctcgattctgcatcaggccaagcaagcgattgatgatgcgctgaacggaattgaacaggatgttccgattgatatggtgcaaattgatttgacaaggtgctgggagctgctgggcgaaatcatcggtgatgccgtccacgaaagcttaattgatcagctcttttcacaattttgtttaggtaaataaaagggaggaaaaaaccatggggtatgaagcaggccaatacgacgtgattgtcatcggcgccgggcatgccggtgttgaggctgccctcgcatccgcgcgccagggagccaaaacgcttgttttgacgattaatcttgatatggttgcgtttatgccatgtaatccgtctgtcggcggccccgcgaaagggattgtcgtccgcgaaattgacgcgctcggcggagaaatggctagaaatatagataaaactcatattcaaatgagaatgctgaatacaggaaaaggtccggccgtacgggcgctgcgtgcgcaggcggataaattccaatatcagcacgaaatgaagcatacgctggaaaaaacaccgaatttgacacttcttcaagggattgccgagcgtttaatcattgaagacggagagtgccgcggtgtcattacgcaaaccggtgctgaatataaggcaaaaactgtcgtgctgacaaccggaacgtatttaagagggcggatcattctcggtgatctgtcttactcaagcggcccgaataaccagcagccgtctattaaactttctgagcacttagaggagctcggttttgatctcgtccgttttaaaacgggcacgcctcctcgtgtctcaagcgattccattgattacagcaaaacagaaatccagccgggggaccaggttccgcgcgctttctcatatgaaacggttgaatacattaccgatcagctgccttgctggctgacttacacgagtcctgagactcatgagatcatcgacagcaacctgcatcgttcgccaatgtattccggtatgattaaaggaacgggaccgagatactgcccttcgattgaagataaagtcgttcggtttaatgataaaccgcgtcatcagattttccttgagccggaaggcagaaatacgcaggaagtatacgttcaaggtttatccacgagtcttcctgaggacgtgcagcagcggatgctggcgaccattccgggactggaaaaggtgcagatgatgagagccggatacgcgattgagtatgacgcaattgtaccgacgcagctctggcctacactggagacgaaaaaaatccctaacctgtacacagccggtcaaattaacggtacatcaggttatgaggaagcagccgggcaaggaattatggcagggatcaacgcaggccgcaaagcgcttggaaaagaagaagtgatcctcagccgttccgatgcttatatcggtgtattgattgatgatttggtaacgaaaggaaccaatgaaccgtaccgtctgctgacttcacgggcggaatacagactgctgctccgtcacgacaatgcggatcttcgtctgacggaaatcggccacgatatcggcttaatttctgatgagcgctatgaagcgtttgagaagaaaaaagcggcgatcgaggcagagaaaaaacgtctctggtctgttattattaagccgtctcctgagaatcaggaatatatccgttcactcggcggaagcgagctgaaagacggagtgcgcggcacagatttaatgaaacgtccggaaatgaactatgaaacagtgacaaaacttgcgcctgcagattctccggttccgcaagatgtggcggaacaagtggaaattcaggtgaaatatgaaggatatatcgaaaaatccttgcagcaagtggaaaagctaaagaaaatggaaaacaaaaaaatccctgatcggattgattatgacgccattaaaggaattgctactgaagcccgtcaaaagctgaaagaagtgcgtcctttatcagttgctcaagcgtcccgtatttccggtgtcaatccggcagacatttcaatcctgctggtatacctggagcagggccgtattgccaaggtagctgaatagaaaggatgacggcatgaatatagaggaatttacatccagtttagcggagaaagggatttccctttctgaccgccagctggagcaattcgagttgtattaccggatgctcgtggaatggaacgaaaaaatgaatctgacatccatcactgagaaaaaggaagtttatctcaagcatttttatgattcgataacggcggcattttatattgattttgaaaaggtcaccactctttgtgatgtcggcgccggcgccggttttccaagcctgcccgtcaaaatctgcttcccgcatctgcatgtcaccatcgtcgattcactgaataagcggattacgtttttggaaactctctctgatgctttacaattggagcatacgacatttgtccatgacagagcggagacattcggacagcggaaagacgtacgggaaagcttcgatctcgtgacggcccgtgcggtggcgcgtctgtcggtcctgagtgagctttgtctgccgctggccaagaaaaacggcgtatttgccgcactaaaagcagcagccgctgatgaagagctgaaagcggggcaaaaggcgattaaagtattgggaggagagcttgaacaagttcattcctttacacttcctgttgaagaaagtgaacggaacattatgatcattcgcaagacgaaaagcactccgaaaaaatatccgagaaaaccgggtactccaaataaatcgccaattgaagggtaatttagacagcctgatgtgacaattccatcatattttctgcaaaattgatgaagatacagcaggaaaaaccatgagaaaatagaattataaaaatggcagtttttaaaggtggtgtaggtacatgaagcattcattctctcgtttcttcgggtttggtgagaaggaagaggaaccggagatagctgagcatgatacaaacaaagaagagatactcgaaataccggtacatgctatcgttcccaaccgttttcagccacgcaccattttctcagatgaaaaaatcaaagagttagcaatgactatccatacacacggcatcattcagccgattgttgtcagacatacagaagatgaaggacaatatgagctcattgcgggtgaaaggcgctggagagcggtacagacgcttgaatgggagaagattcccgcaattattaaagatttttctgatacggaaacagcatctgtcgctttgattgaaaacctgcaaagggaagaattgtcctccattgaggaagctcatgcgtacgcaaggctgttagaacttcatgatttaacacaggaagccttggcgcagcgcttaggaaaaggccagtcaacgattgcgaacaagctccgattgttaaagctcccggaaccggtccaggatgcgattatggagaaaaaaattacggaacgtcatgcaagagcactgattccgctcaaacagccggagcttcaggtcacattgcttgcggaaatcattgagaaaagcttaaacgtcaagcagacggaagacagagtggtgaaaatgcttgaacagaataagcagaaaccaaagccgagacgcaaagcgttcagcagggatacaagaattgcgatgaatacgattcgtcagtcactgtccatggtagaagacagcggcgtcagactgaatactgaagaagaagaattcgaagagtacatccagcttaccattcggatacctaaataaaaactctcctgatcagcaggggagtttttattttaatcaaaaaactattttgagataatgatagatttattgtgcactatacattatatatgtaaaattttatctttttgtgtcgtgaattgtctttttacagtcaaaaaagtcactttatcggagaacttatattagaaagtgtctttttcgtttacatttttttcacttgctgataaacaaattatgaaaaaaataaaacgctttactctttttttgataagatagaaacaagacagtacatgttcatgtgaaggtaggtgacatcgtgggaaaaatcatagcaattacgaaccaaaaaggcggagtcgggaagacgacgacttctgttaatctgggggcttgcttggcttacataggtaaaagggttcttcttgttgatattgatccgcagggcaatgcaacgagcggattagggattgaaaaagccgatgtggatcattgtgtgtacgacattttagtagatgatgcagatgttacagatattattaaaccgacttcagtagagaacttagatgtcattccggccacgatccagcttgcgggagcggaaatcgaattggttccgacgatctcacgggaggtcaggctgaaaagagcattagaatcagtgaaacaaaattacgattacatgattattgattgtcctccgtctctcgggttattaacgattaatgcgcttactgcttcagattcagtcgttatcccggttcagtgcgaatactacgctcttgaaggattgagtcaattattaaatacagttcggcttgtgcaaaaacatttaaataccgacttaatgatagaaggagtgcttctgacgatgcttgatgccagaacgaatctcggcattcaagtgatagaggaggtaaagaaatactttagagataaagtgtatcaaaccattatccctcgcaatgtccgtttaagtgaggcgccgagtcacggcaagccgatcatattatacgatccgcgttcgagaggtgcggaagtatatttagatttagcaaaggaagtggcagcgaatggctaaaggcgggctcggaaaagggattaacgcgttgtttaatcaggttgatttgtctgaagagacagtggaagagattaaaatcagtgatttgcgccccaatccttatcagccaagaaaacaatttgacgatgagtcattagctgaactgaaggaatccatcattcagcatggcattcttcagcccattatcgtgagaaaatcattgaagggctatgatattgtagccggcgaacgccgttaccgcgccgcaaaacttgccggtaaagagacagtgccggctatcgtgcgggatttatctgaatcgctgatgcgggaaatcgctcttttggaaaaccttcagcgtgaagacttatcaccgcttgaagaagctctggcatatgactcactgctgaagcatttggatttaacccaggaacagctcgctaaacggctcgggaaaagcaggcctcatattgccaaccatttaagactgctgacgctgccggaaagcatccagaacctcattgcagaaggtacgttatccatgggacacggcagaaccttgcttggtttgaaaaataaaaacaagcttgaaccgcttgtgaagaaagtggttgaagaacagctgaacgtccgtcagcttgagcagctgattcagcagttaaacaacaatgttccacgtgaaacaaagaaaaaagaacctgttcaagatgttgtgttaaaagagcgggaatcgtatttgcaaaattacttcggaacaacagtaaatattaagagacaaaagaaaaaagggaagattgagattgagtttttctcaaatgaagatcttgaacgtatcctggaactattgtctgaaagagaagcgtaaaaaccatctttttttaaaaagatggttttttatatacgtcttgtcagcttatgaaacggactgagccgttcctgccggccttctgatttatctgtcagctgtaacccctctgctaaaacatttgccatgctcataacaagatgaagcctcgtattctgcaggacaaaatactccataaacccgctgacattgacgattccattgatatggacgtcaccaatttcaggaaggtctttttgaacacctgctccgggcttcagcggcccatcgccgatttgaaatgagcctacgcttttgacgcggcctaaacaagcatcaaccgctataataaacggatttttatgtagatgttgaatatctttcagcttgtctttcatattgacggcgtgaacaggatctgacagcgtgccgtaaacgtgcaatctgcctaaattcattttttctaactttgttcctacgagcggacctaatgaatctccggtcgaccgatctgtaccgatacacacggtgactaacggtctgccggctgctttacgtaaagatgaagtaaggatcgcttgtatttgattcgcagcagaagaatccgtatgagatacatattgttttgcccgttcttgagaaaaaagcccgccttttcgattcataaggttcacttccttgtcatgtcatacgagtattacattgttgtttttggtgatgtaggttgtttacagtatatccagcgctgcctttttttatgcttatgtcatgatcagcatgccggttgtttgaaaagagcgggatagaaaaaagaactcagagcagttattctttaagttcatgaaagaaataagaccatttgatctacattacatattgctgatgatctaatttcagcgctcttttttctgtagaaaagagggtaaatcctaactgagcgtagagtttttttgcgggttcatttgttgagtaacagagagatagagctgtctgtgtctttcatcttttttgctgcctggctgatggcttccgtcagtaacgcttttcctgcgcctgaccttcgatgtttgggggaaatatacatagaaccgataaccgcaatgtgtcttagtttaaacagcgaatgcttggagatcttgaggattcctatcagtctgtctttttcaaaggcgccaagcacgatggcattaccggattcaagcctcgcgtccgggtgatcttttgaagctttgagcctgatatcggtgtaaggcttggtatcatttgcggttaaacgcctgatgtacatgatttgagctccttatataaataaaattttctgaatagtcaatcgtcgttatcataccatatttgtcccatttgtatgaatgattgccgctgtcactcaatatagtagcaatatgcggagatgatcagaaattttatgaggtgatgagggtgtggagagccgggatgaagtggatgctgctcatattaagcagccagattggggccgggtatgcgagcgggcaggaaatatggcagtttttcggtgtcgaaagcggactggctattgtattgtttacagtcatgtttacgatttcggcttatattgtgttgaagatcagctatcgggttcaatcaacgcactttttacctgtgcttgagcatctgatggggccggctcttgctaaagtctatgatgtgcttattatgttttatttgttttcaatgacgatggttatgattgccggcggcggtgtgacgctgcaaatgtacaagctgccgttttggatcggtatttttcttctttgcattgtgaccgtcggtttattcttttgggatataaaaggaatattatctctgaatagtattttgataccgattcttgtagcggggctgttatatgcattggtcttttttcagacaacccatcattacacgtggacgatagatttgacccgccagtataattggccggcaagcattaccttcacgtccttaaacatcctttctgttgtcgctgttctttcttcaatcgggaaagatatgaagggactgggagaagcgaaaatcgcaagcgttgcaagcgggctgattttcggtgtgatttcatttgtttacaatgaaacgcttgtgcagctttcaggcagtcttacacaatatgagatgcctcttttcgccgtccttgaaggcgctccttatccgttatttctttgtatggccgccgtgctttttttagccatctatacgacaaccgtgaccggtctgttcgggctttccagccgcatgcttgcatttgtgaaattgccgagatggacgctcgtagctcttcttttagctgtgatggtgccttttacgacaatcggtttttcagatttgatcgcgattttatatcccatttacgggcttttaagtctttatttgctggtatgtcttcttctttaccctattttagggagatggaaaaaagtataatgctcattttgagtgcggccgttgctcttatcctgtctttttttgtacaataaataaagcagtctatggagagaggtgaagggtcttggcggataaagactttggcctgaatgatattgttgaaatgaagaaaccgcatccttgcggtgaaaacaggtggaaaatcattcggatgggaatggatattcggatcaaatgcacgggttgttcccacagtgtcatgattccgagaagagattttgagagaaagctgaaaaaagtactcgtcaagcatgaggagcctacatcataagggctggcgctcatgctttttcatatagaggagaggaagaggccagatgagcaaagtgcatcagtcagcgtgcccgctgaattgctgggacagctgcggctttttggtgacagttgaggatggaaaggtgacgaaagtagacggagacccgaatcatcccattacggaaggaaaaatttgcggccggggcagaatgctggagacgaaaacgaatgcgccggatcggcttcgttttcctttgaaaaagaaagacggtgaatttgtccgcatttcctgggagcaggcgttagatgaaatcgctgaaaaaatggcggtgattaaggagacgttgggcactgccgcagtgctgcacagtcatgattacgccaataacggtcttttgaaggcgctcgaccagcgttttttcaatggatacggcggtgtaacggagattgcgggcagtatttgctggggttccggcattgaagcgcagcgctgggatttcgggcgttcttacggacatggaccgcttgatatttatcacagcaagcatgtgatcgtatggggcagaaatgtgtcccggacgaatatgcacctctatcaccatctgcagcaggtgaagaaaaaagaagcgacactgacggtcattgatcctatttttaacccgactgcaaagcttgccgatcggtatatatccgtcaaacccggcatggatggctggcttgcggcgggtgttttaaaaatattatgccaaaccggcagaaccgattccgatttcattcaaaggcattcggtcggttttgaagaaatagaaaagcttctgaagacgatttcttttgaggagatcattgagaaaacagaaacgtctttagaagtgcttgaatatcttgctgatttatatgctgacggtcccgcctccacttttatgggtcttgggatgcagagatataaaaacgggggcgggacgatacggtggattgacgctttagctgcggcgagcggaaatgtcggtattaaaggcggcggcgcaaacttcggaaatgtgcaagtcggtgaaagctttgcaaaggccgagctcacccgtcctgatctgaagaaaagttcgagaacgttttcgatgatgactcaagctgaagaggcgctgaatgcagccgatccgccgattgagatgatcatcgtgacgtgcggcaatccgctgacacaggtgccgaatacaaaaaaagtgaaggaagcgtttgaaaaaacaccggtcacagtggccattgattcggtcatgaccgatacggcgaagctctgtgactatgtgctgccgacggccgttgttttcgaagaggaagatatttattattccagcatgtatcatcactatgttcaatatggcaagaagcttgcggaaccgcagggagaggcaaaatcagaccgctggatctggacggaactcgcaaagcgtctcggattcggggagctgtttgattacagtacggaagatttcttaaaaatggggctctcttctttggagaaagaaggaatcacccttgagcaattaaaggaaaaaggacatatgccgcttccggtcaaacaggttccgtggagtgattttcaatttttaaccccgagcggaaaatttgaattcgtctcgtcactggcagaagagaaaggatacagcggcctccctcaattggaggtgccggaggagtctgtttatcatgacgccgggcttgccgggaaatacccgtatacgctgctgtccattcacccgcagcgctccaatcattcacagcacgtgccgtttattgaaaagcttcagcagattcaggtggatctgtcgccggatatcgccgaggagctttcacttcaagacggagatacggcagaggtatacaatgaccgcggcagtctgcgcggcagggtgaaaatcatgaagcaggctcacccgaagacggtgaatatagatgaaggcatgtgggcggcattcggaggctccgtcaacatgctcacaaaggattcaaattccgataatggaatgggaagtacgctttttgactgtctggtagcggttaaaaaaggataatctaaggagtgagagggcgggaaatgcttttttctcagcttgtcttttcctatgaacctccttataattgctctaggtttacaatacgtttatacgatgatggtttgatatagaggagatgaaagaatggctttaactgctggaattgtcggtttgccgaatgtcggaaaatcgacgttatttaatgcaattacccaggctggtgccgaatcagccaactacccgttctgtacaattgatccgaacgtgggaatcgtggaagtgccggatgaacgtctgcaaaagctgactgaattggtgaacccgaaaaaaacggtgccgactgcgtttgaattcactgatatcgcggggatcgtaaaaggcgcatctaaaggtgaaggactcggaaataagtttctttctcatatccgtcaggtagatgcgatctgccacgttgtacgcgcattcgctgatgacaatattacgcacgtgtcagggaaagtcgatccgattgacgatattgaaacgatcaaccttgaattgattcttgccgacatggagacagtcgaaaaacgcatcacgcgtgtaagcaagcttgcgaagcaaaaagacaaagaagcggtttttgaatttgacattctgtctaaattaaaagaagctttcgaacaagaaaagcctgcccgttccgttgaatttacggaagaacagcaaaagcttgtgaagcagcttcatttgcttacgtcaaaacccgtgctttatgtagcaaatgtaagcgaggatgaagtggctgatccttcagataatgaatatgttgcgaaaatccgggagtacgccgcgggtgaaaacgccgaggttatcgtcgtctgcgcgaaaattgaatctgaaattgctgaattggaaggcgaagaaaagcaaatgttccttgaggagctcggcatcgaagagtcaggtcttgatcagctgattaaagcgtcatactctcttctcggtcttgcgacatactttacggcgggcgaacaggaagtgcgcgcatggacattcagaaaaggcatgaaagctcctgagtgtgcgggtatcatccacactgactttgaacgcggctttatccgcgctgaaacggttgcttatgaagaccttttggcaggcggcggaatgtccggagcgaaagaagccggaaaagtgcgtctggaaggtaaggaatatgtagtccaagacggagatgtcattcatttccgatttaatgtataggacacagttgtaaagggacaagagctttggtataatataaacttgtgagtaatagaattattgctccttgcccattatagggccgcttagaccaaaaggaggtgcaaacagatgaaaaagtacgaagttatgtacattatccgtccgaacattgacgaagagtcaaagaaggcagttatcgagcgtttcaacaacgtattgacttctaacggagcggagatcactggaacaaaagattggggtaaacgtcgtcttgcttacgaaatcaacgatttccgtgacggtttctaccaaatcttaaacgttcagtctgaagctgcagcggttgctgaattcgaccgtttagctaagatcagtgacgatatcattcgccacatcgttgttaaagaagaagaataagcaatttgaaatatataatgttaaaaggtggtctttcatatgcttaaccgagttgtattagtcggaagactgacaaaagacccagagcttcgttatacgccaagcggtgcggctgtcgccacgtttactcttgctgtgaatcgtacattcacgaaccagtccggagaacgtgaagccgatttcattaattgtgtcacttggagaagacaagccgaaaacgttgcaaactttcttaaaaaaggaagccttgccggcgtagacggccgactccagacaagaaattatgaaaaccagcagggacagcgtgtcttcgtgacagaagtccaagctgaaagtgttcaatttcttgagcctaaaaacagcggcggttctggatcaggcggatacaacgaaggaaacagcggcggaggccaatactttggcggaggccaaaatgataatccgttcggcggaaatcagaacaaccagagacgaaatcaagggaacagctttaatgatgatccatttgccaacgacggcaagccgattgacatctcggatgatgatcttccgttctaatagattatcgctatattcataacgagaaaggtgggaaatgacaatggcaggaggacgcagaggcggtcgtgcgaaacgccgtaaggtttgttacttcacttctaacggcattacgcacatcgattacaaagatgtagatcttcttagaaagtttgtttctgagcgtggtaaaatcttacctcgccgtgtaactggaacaaacgcgaaataccaacgtaaattgactatcgcgatcaaacgcgcacgtcaaatggctttacttccatacgtaactggcgagtaagccgaaaaaagagcaagagcctgcgggctcctgctctttttttatatcagtccccctccatcctgccgaaatgtttcacatgaaacatggaagtgctcctgacacctatctttgttatcttgctcctctattcaaaaacgcgtacttatgcaatgaatttgtttatactgaaaaacagggggtggctgagatggagacagacagaaatatcctgactgatgaaaagtggagcgcaatcatacgcaatgatgcttcttatgacggagtattttattatgcagtaaaaacgacggggattttctgccggccttcttgtaaatcgagagttccgaataaagaaaacgtgctggtgtttgatacggctgatgcagcgctcgagagacattttcgtccctgtaaaaggtgccggccgaacggtcttcgtcttcctgatgaagaatggattgctcaaatcattgaatacattgaacgccattatcacgaatccctgactctgagtgtactggccgaaatgtgtcacggcagcccctatcatttacagcggacatttaaaaaaatcaggggaatgtccccgattgcgtatatacagaaaataagattgtcgaaggcggaacaccttttaaagcatactgatatgacagtcatggagatcgctctgactgtcggaattccaaacacagcgcatttcgcgaccctttttaaaaagggaaccgggagttcgcccacagaatacagaaaaacggccaaaatgggacagggaggttcaatatgagtaaagagcctatgatctattggacactcttcacacggaatgattggagcctgtatacagccgccacatctaaggggctttgctttatagggtcaaatcatggaagctttgaagagcttgagcagtgggcaaaaaaagcaataccgcaataccgattggcacgtaatgatgaaaagctggcgtcttacacggcagagctgtccgagtacattgaaaatggcagatcagctttttcagtgccggtggatctttacgggacagaatttcagcttgctgtatggaaagcgcttatggacataccgtacggcgagacatactcctattcggatatagcagaaatgattcagaaaccggcggccgtaagagccgtgggcgccgcgattggaaaaaatccggtattgattacggttccgtgccatcgcgtcatcgggaaaaacgggaaactgaccggattcagaggcggtttagaaatgaaaaagcagctgctggcattagagggcggaaacattgaaacactggaataccggctgagccggacaggagggaacacatgaaactgatttcttggaatgtaaacggcttgcgtgccgtgatgaaaaagatagatatcaatacttacgttcaggaaacggaagccgatattctatgtctgcaagaaacaaaagtacaggacggacaagtatcattacagcctgaaggatatcacgcctattggaactatgcggtgaaaaaaggctactcaggcacggctgttttttcgaaagaaaagccgctgcacgtgttctatggactggggattgacgaccatgatcaagaaggacgggtgatcacgcttgaatttgagcatgtgtttgtcgtcaactgttatacgcctaatgccaaacgcggattagagcgaattgattaccgtcttcaatgggaagccgattttaaggattatctgcagaagcttgaccggaagaagcccgtgatattatgcggcgatctgaatgtcgcacacagggagatagacttaaaaaatccgaaagccaaccggaagaacgccggtttctcggatcaggagcgggaagcgttcagcgccctgctgaacgccggatttaccgactcattccgctatttatatcctgatcgggaaggcgcctattcctggtggtcttacaggacgaacgcacgtgagaaaaacatcggctggcggcttgattacgttattgtttcagacagactgaagcagcggatcagcgaagcggccatttgtgccgatatcatgggttctgaccattgccctgttgaaatgacagtggatttatgatgagatagcagtaagagaaatccactcttgctgcttttttatcaccgaaaatggaggagcacatggcaaatataaaagagattgcgaaactggcgaatgtgtcggtggccaccgtatcacgcgtattaaaccgacacccgtacgtatctgaggagaaaaggcgtcttgtgaatcaagtgatgaaggagctggattatacccctaatcgaaccgccattgatctgattcgcggaaagaccaatacaatcggcgtgattttgccgtacagcgaccatccctgctttgacaaaattgtaaacggtatcacgaaggaagcgtttgcccatgattacgtgacaacccttctccccaccaactatgaccccgctatagagatgacctatttcgaactgctgaaaatgaaaaagattgacggactgattgtcacgtcccgtgcgaatgaatgggaaaccgccgtgccttacctggaatacggtcccattgtcgcttgtgaatatacacagcatcaagagattccctgcgcttataatgacaggcaggcagcatacagagaaagctttttgtatttgaagaaccgcgggcatcaagacgttgcttttacatgtgtgcgggaagcggaaaaaagcccgagtacggccgacaaggtaaccgcatataaggcggttttcggctctcttgatgaaacccgcattctggtcggatgccatgatatggacgacggaaagcgggcgggtgagcacttctggggtttcgacaaggcgccgacggccgtttatgcgcacagtgatgatgtggctgccggcttgtaccagtttgcgaaagaacagaaatgggacgcggagatcatcggcgagggaaatctgagcgtcagccgggcattaaatattccatccctggaacttcatttggaacgggtcggaaaggaagcatttttgctgttttttcacgaagaaacggctaaaaaacaaattatgcatcaatttcagcggaaaaagtcttgagctgaaatgggtttcatgctttataactagattgagaaaaaaagggaggcggacatatgcgaattgaacatgcagcgatatgggtgaaagatttagaacggatgaaagaattttatgagacatacttcggcgccaaggccaatgacctttatcataatgagaaaaaagatttcaaatcgtattttctttcatttgactctggatgcaggctggaacttatgaaaaaaggcggcattgatgaagctccggcacagaatatgaccggatgggcgcatctcgcattttctacaggcagcaaggagcgggtgaatgaattgacggagacgtttaaaaacgatggatttcaggtcgtaagcggcccgcgcgtgacgggtgacggatattatgagagcgtgatagaggattgggaaggcaatttgatagaaatcacagtgtaaacagtgcggagtgagtccgcactgtttttttgattaaatttgctgagcatttgttttcgggccgaagaggattaacaaaacggaacatagaagccagcagccgccgatgaacaaaaagacgctgatgtagccgagcttaacggcaataaatccgacgagcagggagccgaatatattggaaaaacggccgagcccgtacgccagcccgctcccggccgagcgatattccgtaggatacggctccgatgtatatgcgtataagtttgaggtgaaaatccgttccgtgacgttgacgacaaatccaaacacaataatcatgatgggaataaacgtcatgccgtataacagtccggcaatggcagtcagaaaagcgcttgcggccagaatccatttcctttggaacgtctcggatatcatggaaccgagcaatgcgccaagcggcgcgccgacagagtgaagcacattgtaccacagcgttttttccatggtgatgccgttgcttttcagcaggctgggcacccatgaagcaaagccgtaaaagccaaaggtttcaagaatccataccgctgacaggatgatggtgatctttaaattcctgccctgaaacagccctaagtagcctgcgtgcttcactgtatgtacttcagccgcctcttttggcgcgggaagcgggcctttttctttctctatacgtgcttcaagacggttcataatggtgtttgcctgatcatatgcgccccgattttcgtgccagcgcggcgattcctcaagccggcggataaaaaagaaataaatgagaccggccgccccccatacgaatacgagccgccacccccatgagcctaaaggaatgacaaaagcggaaacaacgtttgtgacgggaacgccgatcagtccgatcatggcgcaaagggagatgtattttccccgtacggaggatggaaaaaattccgccaaatagctgttcgtcacaatcatggcggccgcgacgccgagcccggtcaagaagcggaaaatcattaaggacggaatgtcccatgccagcgcattcagaaaagatgagatcgaaaagacaaggacaaaacaattcagcgcttttttcctgccgatccgatcggacagccttccgccgatggacgcgcctaaaaacatgcccaggaaggatgcggccgtaatgtcggcaatggtggacagcttcacgccccaatgctcaatcagcgccggagccacgttgctgagcgtaaacagatcagcgagatcgaaaaaatagatgattccgagagcggttaatacttgatagtgcacacgcgaaatggggagacggtctaatcggttcgctacatttgagaatgtctgatgtttcataaaaaaccccctgactttgcaattgtaatcagaaaatactgtaaatttatctgacgaatacattataaaggtctttttttggcaaaaacagagtgtaaataaccagagccaaaggaaacggcatagcgctttcttcttaaaatatataacatttcctatatctgtttctgtttatattgtaaaatgttgaaggaaaggaagttgatgcataaatatgaatacgtttgtacggcccgcagagggaagaaatagtgtatcgagatatcttctttctctgttggtcattgtgggtttgttctttttcggaagcatactgaccgtgttttatatgtttctcacgtccgctttcaatccttcactgacgataaattgggatgaggcggcattaagtgacccgctggcggatatttatttacagcatatcgtctatttcattgcgattccgggcatttggatagcggttcgtttcattatgaaacggcggtttttatccatcatcacaccgaatcagtcgctgaactggaagaggattttctttggattcggcacatatgttgtgctgatgtttgtcgcggggctgattgattttacaattcatccggatcgtttcatgcttcaggaattccatgcttcacgttttctgctgctgttagcggcggccgtcttattggtgccgattcaaacctctgcggaggaatttctctttcgcggttttctgcttcagttcgccggaaaattgacggcaaacgcggtggttctgacggtcattatcggcggattattcggcgcacttcatttcggaaatccggagatggaaaatggagctctctgggcgggaatcggatatgtcaccattggcatgatctggacctttatcacgattaaaaccggcagtctggagatgtcccttggcggtcacgctgccaataatatgtttttatttatctttctcacagaggatcattcggtgtacggcggcattccgtcgatatttacaacagcagccggcggctatgaaatatatgattgcatatcgactctggtgatcaatattatcttcgcatggctcgcgttccgttttgtgaaaaaagaaaagcagcaggccgcctaggctctgctgctgatttgtaaggtgttcatcgcttcatcaatatccgtcgtcggtctccggcaggcgaaattttcacaaatgtagacagttgtcttcccatcgatcatttgataacccgcggcaaagtcagaaatgccggcaagctcttccggatgttctgcggcgagaatcgtataggcgggagtgaaatgctcctgaagcgcctcaatgaaacgttttctgtccgggtcatctttccttccgaaaacaacgatttctttttggggcattgtgtgtgccagtacgctttgcatgaagaaagcgttgctgctcggataggcctctatttcccgtttgaacacggaaaacatcgcttcggctttttcaatcagtgatatgtcacccgtcaggcggccgagacgaagcagctgtacggcagccgcgctgtttccggaaggcactgccccgtcataaacctctttttccctgacaagaagggtttcggcatcattccccgtaaagaagaagcctccgtgccgttcatcccagaacagctccagcatgcttgtacataacgttttcgctttctgcagataagacggatgaaaacccgcttcatacagttcaaggtaagcccagatgagaaaagcgtaatcatcgataaaccctttgtttttcacttcgccctcgcgatagcggaccatgacgcgcccgtccggcatgaggtgccgttcgagaaagcggatcgctgtttccgccatgctgagaaagtcaggctcgtgaaatacctttgcggcctttgccagcccggcaatcatgagcgcgttccatgaggtcagcactttgtcatctgtatgcggatagcttctgttttcacgcgcctccagcaattttgttcttgcctcttcaaggcgttcggccagctcatttccggtgaggccggtctcttcgaggatggcctcacgccgcgtgaaaatgaggtgcgggatgttttcgccttcaaaattgccttgatctgtgatgttatacaccttgcagtaaagcgggccgagttcatcaccgagaagattcatgatttcttttttggaccatatgtaatatttcccctcacggccttcagtatcggcgtctaaagctgagaaaaagctgccgtcttcatgcatcatttcccgctgaataaacgttacgatctgcatcgcaatctgtttgtagcgctcattgcccgtgacttggtaggcttctgtatatgcggtcaggagaagggcgttgtcatacagcattttctcaaaatgcggcacgagccattcattatcagtcgagtagcgggcgaatccgaacccgatgtggtcaaaaatcccgccgttcgccatgccgtcgagtgtcttggttacgccggccaaagcctgttccttgcccgtatagctgtagtagcgaagcagaaacatgagcatatgcggcatcggaaatttcggagcctggccgaacccgccgtacaccgtatcaaacccgccggccagctggcgatacgtgtcatgaaccgcctgttcgccaagcatgccctcggccgggtgaatcttgacttcaagatgagcggcggcgttttcggcgatatcctcgacatgctgccggtcattcgcaaacgtttcggacagatgttcaagcacatcgataaaacccggacggttaaatttgctcgtcttcggaaaatacgtccccgcataaaacggcttctgatctggtgtgacgaacacgttcagcggccacccgccctgccccgtcatcagctggcagattctcatatacacggaatccacatcaggccgctcctcacgatcaaccttgatggctatgaatttatcgtttaacataccggcgatctcttcgtcctcaaaggattcgtgggccattacatggcaccaatggcaagtcgaatagccgatgctgacaagaaccggcttgttttcgcgtttcgctttttcgaaggcttcttctccccaagggtgccagtttacggggttgtgggcgtgttgaagtaagtacggtgacttctctgtgattaagctgttgggtttgttattgtttggcatgggatcacctgctttctcttaaattaattaatcataattatatttctcagtgtgttgagaaacatgtacctagctttatgattgtgctttttcagtcatttcttatttttgtgttttattttatctgggctaattcttttatacaactaggtataaaggtcaaaccagttactccaaattttcctcaaggaaatgaattaattcttggcctcctattaattccaacgttggcttatcccttacgtattctagagcccccttagtgaaacctttattaacaatcaaacttgttgcttttgctagagcctcccctaatgctcttgccctttttacatctacattctttttgtgtcttttacattcaatacttattctgtgctatgaacaagtatagaagatattatattgtctattaggatgatagggggttattgacttggatgtgttgcatgaattgagggcgcaatatggcaaagacagaatttatgtcgagataaatgaccgtattacaacaagagaaaaaaatcgaacctgtaaaagttgatcttcgacattacctttcaggcgatgaaaaacttggacatcgagtctatcttcaaactaatccgcggcggaacagacggctcccagctgtatacatggggggccttgccacaaatatcttaatacctgcgggcaaacttcacggcaaatacaaaatatatttccgccgacaatatggtgaaagctgtgaatgttgttgtggaaagtgcgaagttgtttgagaaaagagcatagcatactaaagacaacgacagcaaaagatagagctgtcgttgtctttagcctaaaaacatcatactgctaacgaaactaataaacttttacaataaacttttgtactgacactccattacttccaataatatgaagatcaacagtctgatatttattctcactatcgtttaaaaatgtgaaagttaccgttccatttaataattgatagggttttaaatccgaaattttttcccctgtcttattatcaataaagtctattgtctcagtttcttcctcacctctcatcattctgtaaaattcagggtgaagtgtaagcttatcttttgtcgtattttttaattcgattgggatacgatactctgttactttatttctcatttcatcaattgtattaattttctttgcttttctaaacgtatgagatatttttagaaactcaaacgtttcattcgtggtaacatttttttcggttactttatagttggagtactccccattcacttgttggtatcgaaataagctgatcaaaatgaaaaaaataaaaaaaacgaccgttactaaaatgattttttttctagtcatttttcttttccttatcgatcatagtttctttaacaattttcccagactcaatatcataaataatatcagaaatcttttgaagcgtttctctatcatggcttgcaaccagaattgtttttccttcattttttaatgataatagcaattggtgtactgttttaaccgcttcttcatccaaagcattagtcggttcgtccaaaataagcaactccggattttccatgatcgcttgagcgatccccaagcgctgtttcatgccgagtgaatactttctgaactttcgcttgtcatttggatcaagacccacacgagagattacagcagaaacttcatgatcattgattttattttgaatcatagatagcaatttcaagtttgcaaaaccagtatattccggaataaacccagggtactcaattaatattccgatactttcaggaaaagaaatatttttgtgtaatacctttccatcaataattactttgccttcacttggtttcaccaatcccgataacacacgaaacaacattgtttttccagacccattaggtccacgaaatccatatatcattccctttttcaaagataaatttatatttttaagaacaatgttctttttgataactttgtttacactttcaactttaatatattcttctgacacgagtttcacctcaatcaaagttctttttcattatcgatgctgtattcattaaaataatcttggttgattaaacatatatatagaactacagcaaatattatcccgaaaccgccaattaaataaatcatttctgaaaataatccgggtatcaaccaagacgtcatttctaatgaaatcgggtcattaattaaagaaaactcaaagtaagtatgaagcatcttatcaagaatgaccacagatgtgacaatgataaagctgtatatgtacttcttaataaacacataacaaacgactgcaaatagtccaatcatatgaaacaacaataagcttgtaatgatatatctaaccatcatcacattcgatgaatagtattgatccaaaggtaatttattgccatataaaaaataaggagccccttctggcgatagccatacattatcccatcttccagacagaaaaacgccgagaaggactccgccaacgagatacagaatggtaaacattaaacaaatccaaaaaacacgagataataatgataaaaatactctctctcgtttttgataacgaataaaacggactgaatcaaaaaaaggcagtaccccgaaagaaaggaacattaaaaacaggggcaacactggaaaggcaaatgtataggaagagaaaaataaattaagcgcctgaggcggtcccattatcccttctttcggaacaccttcttttaccagatatactatacaaagcaaaaaacacaagaaccaaaagcttaaacgccttttatgacgacacatatctattaaaacaaaacgaagctcgttaacgaacaacatttttcttagctcctagaatatatagtaaaagacctaagatgaacccaacgatcaagtgtaaaataagactcttcaaactaacaccatctgtagcctgttcctgcaaaaagctggttgaaatcatttcttgatggccaatcgttgaaagcagcatgttaattatgtataaacttgcaaagggtataagtaaaactataaatgatcttttgataaacattcccgctcccaaagctatacttgcaaacatgccggaaaaaatgccaatgataattacatataacatcatatgaacaaagggatgtgtataatataattctggaaagaaggtattatcagatgccaagggcatctcgttgttaatagctctatcaggccttatatttggaagtttcataaaagacaaatagatatttaacaatagaggaaaaatggcagtcacgactccagctaagaaattaatgaaaaataaactgaaaaagtattgtgtatgcttgcctcggatcattaaaaaacgaataaacccagttgaacgatctcttgcgtaaagatccgataatggaagtgttgccagaattgggagcaagaacatgtaaagagccggataatcggagattccacctatccccatccattttgtatagggggtaaaagaaacccctccagttagttccaaatgttctgttaatggcatttcctctgtccaaaaataggccgtggccaaaactgctccaattgccaatgagacataaaaagacggtcgttttagtaatcgaaatagcagtaaataaaacataaatttccttctctcgcttttattaaatatagaagcgactcagaaaaacctgagtcgccgactttcatatgactttttcataatttcagtcttctgatctcatcaaggactctttggatcataatcaggactccacttaccatatgcatgaccagctgcatttttctttgcacctattgtaacagaaggtgttcccaagccaaaccatgtgttttcaacagccaagttccatagtagttttcttccatagtagtttttctttattgtataatagtgcccgcctgaaacatcttttccgcgagatcttgcccaagcttcataagaagtattattttctgtattaaacatataataataagaatcagtaaattttgttctggatttggtttcgtcataagggtttccttttagaaaccgaaaattataatctgcattcttatagtttgcggttggttctcctgcataagcatgcataattcctatagtagaaagagataatcccagtactaaagttagtgtagttattagcttctttatcatgtgtttctccttattgtttttctaaaataaaaaatttatctgcaacgccgatgcaatcaccatttttatttaaccaaatcattcttagcgctatctttgcttttttgcctttaaatttaggcaaattgattaaataatcatggtctgcatcttctctttcgtaagactgtttccaactatatgtatgtcctttatcatctttaacctttcccaatatggttgacggaaacggctctttctgactaaaggtcatcgccagttcataattcttaggaagcggtccgacttctattttcttgcctttaaaaaccctatcaattctcacatcattattttttatttggccttgataataatgattaccctccaacttattccaaaatacaacctcgaataaacttcgaccttgttcggtatcaaaataaaaaatattcggtctttctttattgttgttatccaaatcttcaatccttatagaaggatctggggttttttcttttattacgttattgtatttgtttgtttgacatgcactaagcatagttatagcaattagactaaaataaaccaaaaatatttttttcactttcttctccaaaaaacccttaatttgtaccggtactaaatgattataacatatattaaaagaaaataataccttttaatttatttatttcaaatgctgtgttatgctaatacctagttgatttataggaaaggaatttattttatgaatagtttattcttgctttttaaaagggacttggcccttggagttaataaaaccaccagggttttcattatattatttatgattgcgctattgaattttctttatcctctgtattttcttcgtactaacatacctgacagttctattgccttttgggatctcattggtaaaacctttttaggtgtcccttttgaacttgtccaacaacatacatttgagtttccttttgggtggttactatttcagttaagcggggcaatattgatcaacacatacataaaggatgatctatttgctcacagtgcttttgtcaggatcagagcaaaatcaatattcaaattatgggtaagcaagctgtttttttcttgtactgtaatcattgtgttttacatatcattattgtccttaacttgggttgtttggaaattgagtgggggtacaacatgggagttgacagtttacggcgaaagcattttgagatactcatcatttcaattatcctatagtcaaataattatttattctattgttttaaatataggcggaacatttctcattacttttatttttgcatttttttcgttaatctttagtacaatttatagcttcgtaatttgtagctgtattttgtttttctcaattttttcagatagcccgatattacttggaaatgaaagcatgttgattagacatcctttatttggtttctctcctgttgtttctattagtatttcattagtcacaatacttactgtttgtattaccctcttaattggaggaggtttatatctatcaaagtgtgaattgatatctgatgcaaaaatggaataatatatcttaaacacactaatctggggtctagaaatttaaagtagcttttgaatttattatcaaacttttttccttggtttaaaactggatcttcgacttgctgaaataaaaattcagcacatgctgtgtatctggagccttttgtatcccccttttctgaatccgtcagaacaatacttacattggcgaatgacaagcaacccatgattatactcttgtatgaagtgtgaaataaaaaagctataccctacaacgtcaattcgaataagaaaccacggataaaagtatcccccatgccgtcttcatcttttgggacaatgactttgaaatagtcggtaaaaagcgacggaactgttaattgcaaaaaaggctgccggcacatcatctatatcaacgggaagtatatcctcccgccgatgcatattaaaacaatggataagaatggccatgttttatatttgggaaatttattgaaaattttaactccggggttaaggattggatggatagtggggccgaaccaggatattaaatgcagatagattacggatgcaggttcattatcccaaaggttgcagcgggagtggtttatatccgatcaatatcagcaacacttagaacatgataataagttcctacaaaccattcagcagtttttatatcttttaagtatatttttccttctttaattattagatgatctaagaaatgatcaacttcctccattgtgatgttttcgtaccgatacatatctcttaaggtataatcgattctgtcagcgcataactcaggagctggctgttcgagcaaattccaattagaggtgtctaatagaatgtctttgtaatttaatccatatgtactgagaatatgggggatttctgaatcagttatgatttgatgataaatgttttcgtgataatcctcatttttattgttaaatacaaaatcaataacgtgtgaaaatgcagtatgagatacatcgtgaagtaaacctgcgatctgttcttctaaagagccgcccaatttttttatgagaagcattacgcctatggaatgttcatacctcgtgacattccacttttgattcacaacataacttgctcctccttggtaaacaccttttagtctttgtactggatgactgaaaataagctcttcaagaattccatctacaacataatcgccataaatactatctgttatcttcattttccttaccccccttttatgcgctaagcatggcaaagaagctgcaacctatcgcatcatggattttcttccttttaatattgatatacttaacatatcacaattctgaaaaattcagttgagcctgattatatttgctttcaaatagataaaacacaccccgacgactgtgactgctccgcccaaaagagaaataaacgcaggtacttcacctaaccacacccaagaaatgaccaaggctatagcgggtgttaaataaagtgaaatggttgcttctgaagcaccgacgagtgaagttacataagcaagtgcaaagtaaggcacaaccgttggtaataaacctaagtaaacgatagacaatgttgagttcattgaagcgttcaaaaactcttcccctaagccaggcagaaatacaagcataggtactgtcccgccccaaatagtgaatgtaacgaatggaataaatccatatttttttatatagcgagcttgaaaaacgaaataaatactctccgaaaaagctgccagcaggattaacaaaatgccgttcactgaatttgtatagtttcctgccccaaatgaaatgatcgacacacccaataaacttatgatagagccaatccatttataaagcccaaaatgttcaccaaaaaacagacgggataacattgcagaaaaaataggtgtcatggtcacgagtaagcttgctgtccctgcgctgactgttttttctccgatattcagcaaaatgtgatatagtgcaaaacctaaaaatcctaacgataaaatagcaggaacatccttcatgtcaggtaaacgcatatgagtcaaaatagcaaaaaccaccagcaccattgacccaatcaacaagcgaaacaaagcgaggtgttccggcgtgtaactctccaaacccgcgcgaattcccgggaaagctgatgcccacaacccaatcatcagactgtaagatataccgattcgaactgttttctttcgcatctttctcactcctctttacaaaaaccaaccagttatttaatgtgtttctatattaataaagatttgatgatatgacttcaaccagttaaatagattttgacccaaccactttaaggaggatactttttatgagcgctccagaagaaaaaaagatgaaaaagcttcctaagtacatacaaatcattcaatttataaaagagaaaataggaaatggagaatggccgattggaagtaagattccaagccagcgcacgcttgccaaacactttgaggtgaacaggagcacagtcattacagctttagaggaattgacggcggatggattaatcgaaggcagaatgggcaaagggacagttgttacgaacaatacatggacacttttggctaagaattccgcccccgattgggatcagtatgtaacctccggaatccagcagccaagccaaaaaatcgttcaagagatcaataaatcagaatcaaattccgatcttatacagctcagtaaaggagaactttcacatgagatttttcctttagctgctatgaaaaagatgatgggaaaggtatctcaaaacatagaggcattcgggtatgaggaaccaaaaggatatttgcctttgagagaggcattaagcggctatttaagaacaatcggtattcaagcttcatcttcttccattcttattgtttctggagcgctgcaagccttgcagctgatatcaatggggcttttgcaaaggggatcgaccgtttatcttgaccagccttcctatctttattcattacacgtatttcaatcagccggtatgaagctgactggagttcctatggataatgatggacttttgccggaacatatccacatggcaaggggggaacggggaagggctattttatatacaaatccttgttttcataatccgacaggtattttaatgtcaaaaaagaggcgagaagaaatccttgcggcaagtgagaatgcacagcttcccattattgaagatgatatttatcgtgagttatggatagatgaaattcctccagatcctattaaaacaatagataaaaatggacatgtgctttacataggaagtttatctaagacattaagccccggcttaagaattggatggatcgtcgggccggaaccagtgattgaacgtttatccgacataaaaatgcaaacagattacggctccagttcgttatcccagagagtagcggcagagtggtttacatccggtgaataccagcagcatctagaacaggtgagaagtcaattaaaggtgagaagacaattggtcatgagtctcttagaaaccaatttgaagaatgtcgctacatggaatatgccgaagggaggattctttgtctgggtaaaaatattgccttcactatctatgaaattactttatacaaaagctttgacaaaagggatacttctcaatctcggcagtatctatgctcaagaaaaagggaactatattcgcttatcatatgcttatgcatctcttgaagaccttcaaaagggaatttatgaattgggtttgatgattaaggaattggcaagcagataaatatataatgattactttaatagaaagagacatgctatcaatgacaagaatcggcttgttttcgcgtttcgctttttcaaatgcttcttctccccacgggtgccagtttacgggggtgtgggcgtgttggagtaaatggagacatctcatcgattaatctattgggtttgttgttaattggcatgggctcacctgctttcatgatcctgggaagttttcgagataaaaagagaaaactccggtgatcaaattcgattaagttaaatggcgaattgttcgctgactacggttggggtactggtttaaaaataatgaggagaacttgatattcaaagaaccgtaagagaaagattatctttaaaaccgtcactagcagaagtcttcaaaattatttaagttaatatgccagtctttattgagatttgttttaaatatgtatgtatttgaaggtcaattttctttatagtgactaggaaatacactactttataactgcaatttattaatgaaatatttcctaaaataactttgatttttaattgtagattgatataatatatttgttattcttggccaaggatgagaatatttacaaatcttcaaaaagtggtgttatcaattaaaaaacctcatattttattatttatattaatctttacattaggtttttttgcgtgctttttattcatttttaagcatatagagagaaatggaacagaaaaaattaatcataaccgtgtacaagaagtaccgtggggggtgaaaaaaatcaatgctgcttcaatatggacttcaagagagaaacagaaagtgaaagttgctatattagacagtggtattgataaagagcataaagatttaaaagggaaagttaaaggagaatttaatccaataaacatgactttaacctcagatgatgatgtggggcatggaactgctattgcaggcattatagcagcaaaagataatagttttggattagttggaattgctccagacactgaaatatattcagttaaagtactaaattcaaaaggaaaaggttcattagataaccttgttaaagctatagagtggtgtattgataataatattcaggtaataaatttgagttttggattatccaaagataaaccgttgttaagaggtgcaattgataaagcagtaaacagtgggatcataatcgttgcggccgcaggtaacaattatggcggagatgttgattatccagcagcttatgaaaaagttctctctattaatgctgtagatagaaataataaaatagctaacttttcacctaaaggaaagattgacttttctgcacctggtgtagatataccgatactatccctcaataatggatataaaactgaaagtggtacatctttagcagctgcacatgttaccggtgtaatatcattaattttacaaaatagagataaatttggaattaattcaaaagaggatatttataatcaggttaaccatgtattgttcaaattgtccatcgatcttggaaagaaaggaagagatgaaatttatggaaaaggttttttatcttttaagtaaaggggttaatttgaatgaaatgttttaaaaagagtattgcagttattttaagcctagtattaactttcacttttattttacataatgaatcaaaagctgaggctttaaacaataaggattaccaaattgtaacaaacgatgaagagaaattagtaatcacagcagaaaaaggcggagttaaaggtttaatgactttagataaagaaaatatgaaactttcattaataaccgatgaaatttcgcagaagactggtgaaaaaggtaaagaatataaagttaatattgaaaatgctacaaatgagaagatagaagcaacttttactgatacggaaacaaataaaaaatatgagattaattcagatgaggtaacagcttcttttgtttggtttatacctataggaatagttattggagaggcacttttagcgcatttaatttcaattggattagctgtgactatttcaggagtgacttatgttgcctattctgagtttaagaagcgtaaaagaacctattctcattatatggcagtaagaaagtctaaaggattatttatcggtaatggtttgaaaagacctgctgcaattgcacgccttaaaaggggtgatgacacttggtctacgtcgaagaacaatgccaaatctattgctaaagccgcaagtccgattaaaaaaatagttggtccggagatagataaaaagggtaaaggtaaacattatcattatcactcgatctctaggtataaacatggaaaaggtgtccgtatgaaagctcatgctttctatggtgcagcaagataatatagattaatttataaacatctaactttaaagtaattaaaagataggagaaggaggtaactatgttaattattgatcacaacccaaaggatcagctgtattcagagttaattgatttggctttcgaaatttgcgacgaatttcatttagttttaagaaaagatatgggatctttaaaatcattcgatcctctgttaaaaaaacttgaaagttcgttgaaagtaatgaaagagcaatcagaatgggccagtactattctaggagacaatcaaaaagcaaaagtttattactattatacagatgaaaacgcaaaaaacattctgaaagaatccgcaaattctttatatgcttgggagcagccacatttaccagaagacttgtcttttttcaaagatggaaaggagtggttggtaacatgctctcatgaagaagaaagttatatcgatactgaagatgataaagaaatacaaagaatattgagtataccaggattaaaagtgcattttgaaaaatgggattaaaaccattcaactttttataaaagagttgcatggtttttagtgaataataatatatataagtaaggaaaccgtatagaatggtttccttacttattaaactaacattattcaattgggatttttcttgtttatttcttgactaatacatattgtttatcttccaaatagaatatatgactaaggtgatttatatctttaaactttatatgttttccaaattgtaaagtatttaaattgataactacatccatactgtcatctttatcttcatcttcatatccatctaagcaggaatatatttcaactgattcaccttttgacaagtgtttttcaatgaaaagaaaaagtgatttaatagatttacgttggccaggtgtattgttggcgtgtaagtacccttgtaattcatatatataaggatgtgtgaatttgtttctgactgcttcatatccaggatctaaatgaacaatatcaattccgtatgcatcttcttctgtgtcataaacctttacaagtgaattttcgctgttctttcgattttttttaaattgatagcgtttgttgacatcaattccttttatttctagttcggaaatgggcttaagtgtaggattcctgccatactcaccaataggaagttctttgtcagccccaataaaatgatgtaaagtcaatctatttcctcctttattttatacaactaaaatactcaatctgactttggataatgagatcttttttgttgtgtctaactatgatactccgtgtttgcttgcctcatcaaggcttgataatgtttggaggctgaagatggatgatgtgactgatttttaggcacaagtttttctttagggaaagaggaaccgaattgaattaatttaattgttatattgtcgacgtatactccatcaatgtccatttagattgtatgtttacagctgcagctttttcttcgactatttctaacgttctttcaagttgattatatatgtatccggaaaattaagtataccgtttgaccaattccagcgttatgaagatttcgttgccagaataccaacaattgaagaaaaattgaagcagaatagcattaaatctactctgccggatgcagcgccaacaaatctgcattgggttcttcctcaatatgtaacagaagcagtggaggaatttttaaatcatttgtctttattatctgaagaccttattaatggtgataccttactgcacgctccggtatgggaactatgctgggatcgtgttcaagcagaagagggtcttcgtaccaatgtacctggattctatgttgccggagatgccattggatgggcacgcggaattattcaagcagcgactactggaatcgttattgcaagagatattcttaatggtaaaaaaccttgcgataaggagctgacatctactgtctaaaaggaggactaacagtggaaaaaacagagcacccaagagtgggagtcggagcatttattctgaatgaggaacaggaattactattagttttacgaaagaaggaccccgaagctaatcattggagtatacccggcggtaaagttgagtggatggaaaaggcagaagatacagttatccgtgaaataaaagaggaagtaggggtcactattcaggttgattctttactttgtgtcacaaaccatattttacatgatgaggagactcattgggtatgtccgacgtatcaatgcagtattcaaactgggactgtaagaaactgcgagttaaatgcaataattgatgttggctggttttctcttcaaaatttgcctgatcccttaacgttaactactaaaaatgctttagagagttatcttaataaatttgaaagtcagagaaaataaaaatgcatacaattttattcgatttagatggaaccttggtaaatagtgaatggttggcaaaagaggcttataatcatggaattgaaacagtattaaagagaaaattaacgaatgaagagagagagtctcttgtcggtaagcctattgcggtttttttgagaagatttccaaacgaggcagagcaaatacgttcctcgatattgcagtatttcgaaaataaaatccatcaaatcagaccgtatccgggtgttatctctttgctggaaagtttaagtgaaagaggatatggtttggggattgtgacctcacaattgaaaaaatttgcttatggcgagttaatcaataataaattagatgggttttttaaagtcgttctcacggctgaagattgtgatgagtacaaaccgagtcctaagccattactaacagcgataaatcacttacatgcagatataagcgattgtttatatattggagatcaaatgacagatattgaggcagctcatgctgctgatatgaaaagtgcgggcgcattatggggagaggggaatcttacacacttatctgcagcttcaccgacatactttgtaaaagaaccccatcaacttcttcggattctgcaagacaaaaactattccgctgctttttaacattctcacattaaaggattcaggataaaaaagccgccgacaaagcggcttttcttaagttaagatgccaaatataaaaaaaaggctaacctctgctctccttgttttattcaaacttcaatctgtatggttatgtctttcctagaggcacataggcttggtttttgaagagtaaatcttttttgttttcggttgatcatatgtaaaagcgattattttaatcgctttttgatacttcaaaacatgctaagctttgacctctttatcagtaagcactcttaaagcatctctcacttttaaggcgaagttgacaggtttatcaatcgattcgaaatgaatatacatcagtctcggtttatcaaacagccagtgattgtgaagtgacgttacagtcagatcatgtttccgaaggacgctgataaatggattgatttctttttgcagaattacagtttctccgctgcaaagagcacggccgtcttttgtcattgattcaaatgaaaacatttgcggaatgagcaaaaatgatcttccgggccgtcccagtactactggttttatattcgttcgggatctcattactgtacaaattccattttcaaacgtatgcatggttccgcctagaatatcgttgaattcgtcacaaagaccatgccgttcaatcatttccccgtcagtttttggtaccgcacgcacagttttagtagttagaactctcagggcctctctcacttttcttgcaaaattgagaggtttatcaattgattcaaaatgcataaacatcagacgcggtttatcgaacagccaatggttatgaacggcagttacgatgataccgaatttgcgcagctcactcattaacgggttcacttcttcttgcagtaaaacagtctcacctaaacataaagctctgccttcccgatccatgctttcaaatgaaaaggcctgaggaataaaaggaaatgcctcggctcttcttccgagtaccaccggatgaatgttgcttcgaaatcttgtcgccgtacatacgccatttacgacactgggcgttgaattgagaattctagcaaattctttgcagagccgtgatggctccatactcgtttcttccacttcatatctcctcctggaatctatttataacgtacttagtattaaagatatgtgaagatagaaagaatgtaacgcgtcagcagtccatattagagagaatcagcctttcttgcataattcaggatttcattccctttttataatctctttaactgttaatttttaatagattaaaagcttttgatcggactatttaagaaatgaaaacactataaattggtagttttatcctgggtttgatttttttaaggcgttcaggctaagaaaaaaagcctttatacaaggctttcggtaaataattcatacagccgtttggctgctcattcagtgacagctcacagctcttttgtcatcaagacatgcgggatgccgtcttccataaattccggtgaatctgtctgatagcctagtttgtgataaaagccttccgcatgtgtttgtccatgcagtttacattgggtgatgcctttttcttttaccatgttttctaattcgcttatgatgactttgcccaacccgtatttgcggtaaggcttcaggatgcagattcgttcgagcttgcctgtatggtttacgatgcggacgcgtcctgtgccggcaggctgattttcatgataaaccaagacatgcccgcactgttcctgaagcgtatcgaactggtcaaattcatcggattcaggtacttgctgttcctcaatgaatactgcttttctaatctcaagcgctgcttgtaaatcaatttccgttgttatcctttttatctgcatgatcaaccaatccttttcacatgttagtctggactgcacggcttgcttgtgttcttatagaagtaacgataaaacaattatattgcaaatgcaacaaaaacatgaagggtttgaaaaagatatgactgatattttgcgggaaatcggcatgatcgcacgggcattggattccatcagcaatattgaatttaaggaattagacttaacaaaagggcagtatctctatcttgtgcgtatatgtgaaaacccgggagtgatacaggaaaaagtggcggaaatgattaaagtagaccgaacaacagcggcgagagcaatcaaaaaattggaaatacaagggtttattgaaaagcgtcctgatgatcaaaataaaaaaataaaaaaactgttcccgactgaaaaagggagaaaggtttatccgttattgcaaagagaaggagagcattctgcggaggtagccctgtccggctttacatctgaggaaaaagaaaccattttcagccttcttcagcgggtgagaaaaaatatagaacatgattgggaatatgtgaagaaggggaataaaagagattattgatggttattaattccttttggtgaatgattaaagtcataaatggatacgttatctgtgaaatctccttcctcggttcctgcttcaactagccgataggcttatttttaacgaaaagtatcaattatggtatatttaaataagacaaaataattgaagcggggaatgatatgagtacaatcgaaaaacaaagacgtaagaaattcagagccaaatcaatcgtacgggtcatcatggtcatcatcggcggaattattgccgcgtatggactggaaaccgtactgattccgaatagtgtatctgacggcggtgtaaccgggctcagcattgtcggttcacagctgtttcatttgcctcttgggatcttgattgcggtgatcaatataccgtttgtctggttaggatataagcaaatcgggaaaggttttgcgtttctatcaattatcggtattgtctcacttgccgcgggcacgagttttttccaccacacgccggctatcattgagggagataccctgttaatcaccgttgtcggcgggattattctcggcttgggaatgggattggcattgcgcaacggcggcgccttagatggaattgatatgctggctgtgcttctgtcacggaaattgccgtttggcacgagcgatctcattttatttttaaacatttttgtgtttatttttgtttcttttgtattcgggctgcaaggcgcattgctttccgtcattgcttactacatcgcatccaaggtgatccatgtggttgaggaaggcttaagcggttctaaaacatttcagattatcaccaatgagcctgcattaatggtagagaccattcgtgaagaattgggccggagcgctacttataaagaagcatacggcggtttttctcatgaaaaattccaagaaatcacatgtgtcatcaaccgtttggaagaaaccaaactgaaggaaattattaatgacattgataaacaagcctttgtgacggtatatgatgtcgcagaagtaaaaggcagtaatttcagaaaagtccataatcattaagtagagagctgccgttaaccggcagctttttttaaaaaaggagaaaaaacttgcaaaaaaagaatggcggctgtatattgttgatatatcaaacattgactagtcaattaattgcgcaaaagaaagtggggatgggttttgacagcatgttgttcagaggaaggcgagattttatatcagctccaatcactgcacaaagtgatcggcacgaagtttgaagcgtgcaccggaatcagccaatcccgccttgagcttctcgccgtgcttttttacgtcgacgagatcagccaaagcgatcttcagaaaaaggtgaatattgatggcgcagccgtgacaagacacttgaaacagcttgaagccaaagaaatggtcacaagaaggcggaagcccgaggacaaccgaattatacttgtccggcttactgatcaggggcgggagagaattgaggcttccaaaaaggagaaggagcgtttcataaaggaaatgcttgccggtgtcagcgaggaagaacgcagtatgttaaaaaacgtattgtcgcagatgcagaataatatagaaaatatgaaagcataggagtgtattacacatgaaaacagaactgaaaacaaacgactttatggacattatgaaaggccgccgttccattcggaattacgatccggctgttaaaatcagcaaagaagaaatgactcaaattctggaagaagcaacgacagcaccgtcttcagtcaacgcgcagccgtggcgttttctcgtcattgacagccctgaaggaaaagaaaaactcgcgccgcttgccagctttaaccaaacacaagtcagcacatcatctgcggtgatcgcggttttcgcagatatgaacaatgatgactatttagaagaaatctattcgaaagcggtcgaactgggctacatgccgcaggaagtaaaagacagacaaatcgctgcgttgacggcgcactttgaaaaacttccggagcaagtgaaccgtgaaacgattctgatcgacggaggcctcgtttccatgcagctgatgcttacggcacgcgcgcacggctatgacacaaacccgatcggcggctacgataaagaaaagattgccgaggttttcggaatggataaagagcgttatgtaccggtcatgctgttatcaatcggaaaagcggcagacgaaggatatgcttcctaccgtcttcctatcgaaacaatcgcacaatggaaataaggttgaagtgaagctgagaggagagggacagtggacataattgcggctgttttcgtcggaattgtagctttagaacatatatttatcatgatacttgaaatgttttttatcaattcgaaggcagctaagcggtccttcaaattgccgaagcatttagaaggtgatcggaatgtggcggtcatgtttgcaaatcaaggtctgtataatggatttctggctgccggcctcatttggggactgatcctcggaactgatccgattggccatatgattcaaatgtttttcgtcatctgtgtggtcatcgcggccattttcggaggctttacttcaaacaaatcaattatcgtaaaacaaggacttccggctgttttagcgcttatttttcttttattggcgtaggcagaacggagtgagggcttccggaatgggagccctctttttttattctgttttgaaaatcattcctgataaatggatgattccggccgcttgttcttaagatgatagattaatttgaaagccgatgcctgcgcgcatcggctttttttcggctgatagaaatacattatagtatataaaacaaaaagggaaactgctcacagaatcgaaataaataatattcgcactaaggaaaggtgtaaatctatgagcaaaatcgaagtgaatactccgccaaaactaaaccatccgtttctcgccggaatgttgtttatgattgttggtacgctgtgttttgcctcaaagtcgatctttattaagtgggcttacacattcggagccaccccggagtcaacgctatttttcagacaattgattgcaacccctcttttttgcatcatttttcttttgtatcgtgcaaaattatctgaaaaaccggcaaaggctgatatagtcagagcaggaatcacgggtctgctcgttttttttctatctccgctgttggactttatcgggctgcattatgtttcagctattgtagaaaggatgctcgttatgagttatccgatttttgtcatgattatctcgtttttcggaaaaatggagaaaatcaccgctgcagacatcatttctgtcgttgtggtcagcataggaatctttttttccattggcggctggaatctgcacgaattgagtgctaatatatttggcgcttttctcgttcttctgtcgtccgcggtttacggactttatttggtcttatccggtcagcttgttcgcaaagtagggagtatccgtatgaatgcatatgggatgtccttagcaagcattgccatggtgctttttttaatcgcaagaaagggttttggctatcagacagagctatggtcgtttcagccacccgtatatttcctttttttaatcattgctgtatttacaacagtcgttccttttttatttatgctggaaggtatcaaacggattggggcagtaagagggtctttgatttcaatgatgggcccgatcatcacaatcatctttggcgcttttttcttgggcgagcgcttaacatggatacagtggataggctgtttcattgtcctaagcatgattactttttcggaaggcaggaagatcaaattaaaggtgagagcctgacatacgaaagcctcccactaaggagagaaagtaaacgaaaaaataagccgatgcctgcgcgcttcggctttggggagtgaggttgctgaggatgaatatgaagagagcgtattatgctattttatacagccagaccgctatcaacttggggttctcactttatacgatggctgtcatcttgtttttgtttacaaaaaccggttcgacggcgatggcctctcttatgacgttcgtcagcattgtatgtcgcgtattgggcagcgccattttgccgctggtcaccggccggttcacgcttcggtctttgttaatcggttctcaattgatacagatcacactgttagtctgtttgttttttgtcatccaaaccggttcatccgcattcttttttctgatgttttgtctgatcggaggcatttctttttgcaacggatggtttgctccgataaaaagcgcgctgattggggaaatcattcctcctgatcgaagggcgaaagcgaacggtttattatcggcggcggatcagaccgttcagtttgcggggtggtctctgggcggcgtcatcatagcgttcctgggagagagcgatacaatgatcgtcactgtcatgttattggtttcttcggtgttgggcatcattctgtttcttcaagtacgcatgtgtgcgccggcagcagtcagggaacgttccctttttgcagatgcggcaagcggctgggtgtatttatttcagcaaaaacagctcagggttctcattgtgatggatgtgatcgaatcgtgggcaggcatgatatggatcggttctgtgtccttgacttatgtgcatgacgtccttcataaaggagaggcttggtgggggtatgtcaacggagtctattatgcagggacgatgatcggcggactgatcatctataagttatccggcaagtttcagcatcatctcattccgcttatgctgacgggagccttggcatatggaatgttcacgtttatttacgggctgatcacaagcgccgttaccgccctttttctggtgctgtgcatggggccggcttgtgtattacgagatctcacgcaggaaacattccttcaaaacatcacgaccgaaaagacacgggtcaatatattagcggcgagatcagctttagttcagttcatttttatgttttccattatcggaacgggggttatctcggatgtattcggcgtgcggtttatttatattggcgcaggcctcctcttattaatttcggcttttatcggattttctcagctgcgaatgaagaagatggtacaaagccgcatgtagtgtagtataattaggaacgtacgttctatatcgagagaggagagggtaatgtgggacatctggcactgcaattgtatgattatcatctttgggcaaatcagcaaatattcacccggcttaaagagcttccggaggatgtgtaccgtaaggagattcaaagtgtctttccgtcgatagccggtgtattgactcatgtgtatctgtcggataaggggtggtttgatgtgttctccggagagcgtctggaggatacgctgaaatcagctgaacagcaaaaagaggacatcttgtctaaagagatagaagagctggaagatatgttctcggaattatcagatcgatatcaattatttttgcaaaaggaagaaaatatcagtctcccccttgaaatagagcatccgtcaggtgacatcatgaaaaccgcagcagccgatatgatcctccatgttgtgaaccacggaacgtaccatcgcgggaatataacagccatgctcagacagatggggtatgcttctgtgccgacggattacggtatttatttatatataaacaaaaagtaaacaagacagccaacgcggctgtcttgtgatatcagtaaaaaagccaaatcatatgagtgatttggctttttcgtttgctatgccatgttctgcagccgttctaaactgtttttccaattcgcttcaagcgctgtaaaagcagcggcggcatcttgctgttctaatgcgtgaatgatatcagagtgttcattatatgatctgtttaaagcgtcgttttcactgaaatagcggatttccattctctgaattttgactttcaggcttactagcaatttgtgaagttcggcgttgtccgcaagcagaatgatgcgatggtgaaatgcattgtccgcttccaggatggccggtttatcgccgtctttcatcatttgaagaagattttcattcagctgtttcaattcctgaatcacggcatcgtccacatgcgggagagcttgctgcaatgcgagtttttcaagcgtccagacgatggaatacaagttttccgcttcttttaactcaatcggagcgacaagcgtccatctgttcgcttttgttatcaccaagccgtcatcttccagccgcaataaggcttcccgtatcggggtgcggctgattcccaatgtttccgacaaatccttgtcctttaactttgtttccggtttgagcttgcccgttatgatccagtttctgagtgtgcgatacacttcgtcccgcatgatggttcttttcagcacaggttctttgttttgattatccaatggaacacctcatgaatcgtagtatacatatttgcattttaccacagtccgggcgccggttagaaatgaagagggacgtctaaggatgaatcgaaccgagatgcttcatctcaatatgctgaaagtcagcggagccgccttcagaaaagagcgtgattccctgatcttcgtgttttgggaacacttcatttgtcaaaacggtttttccgtcgtctgcaaatacttcaatacttgttttatctacgagaattttcagatggacgcgtcctttgtttccgtcaaatggggctttgctttcgacgtatgcgccggttttatcaggctggtctgtaaacgatctgttcacataggcacagccgtcttctgctgaaataccgacatcaatatgccggctttggtctgctgattctctgagtctgactcctgcatttttgatatctgaccaagcgatatccatatcaagctgatatgtatcacctttgatcggcagtgtctctgaaccgttcacctgtttgtgttctatgctgtcagttgaagaggttaattggttcaatgcttcaaccggctctgacacaaggctgtatgtgccgccgtcctgctgctgaaggcggatttcacggacgatagaatccgtgccgttaaagccgttttttagtgtcggtgtttcattcggataatcccaattgttcatccatgccagcgcatagcgttttgtcagcggatcttcgctattaccgtcttcaaatgtgacgccgccgtaccagtcaaagccgtaatcgagccattgcggttcttcttgatcggcggtaaattccttcccgtcaaagtttccggtccaatacgcgtacgtattcggtttgcctgcgggtttgccgtttgcgcttgcgcccagaacccatttggctgttccgtcatctgcacgcatcatataaaggtcggggcattcgacgaggccgatctgctgagtgataaagccgcccgtgtatttccaattttttaaatcgggtgattcataaaaaccgattttttctccttcggccatggccatcacccatttgtcatcctgttcatcccagattactttcgggtcccggaaatccttagttcccgggtttttcataacgggctgatcactataggaagtaaacgtttttcccttatccgtgctgtaccataaatattgttcctgggcttttgttttggcagtcggctgcgttgtgacggcgaccagcgcgtttttgccgaagcccgccgtgttgtgtttatcaatgacgacagaaccggaccatatatcgccgttttcgttggtgtatttcggaatagccgtgccttcgtccgtccagtgcaccaagtcctctgatacggcgtgccgccattctgtgccgttgccgttcgggtaatcccgattataaagatagtagtaatgatatttcccctcgaaaaaaatgggcttttgagggtcgtttttccatttgtccggggtcgtaaaatgatacgccgcccggtaatccttcttatgctccgtgtttgtgtcagaggaattgtgggttttgttcggcagtaagccgacaaacaagaacgcacccaaaaagatcaatattacaatgggccattttcgtaccatgattgaattcaccatcttgttgagaaataaaagaaaatgccaatgaagtatcggcattttctttttgttgttattagttgttaaccgtaagctgtccttgttcaaggatgctgtttttaacaacggatgttttcttgcctttgatgttcattaagaagcttggcgcaaatgttgcctttttatcctcaaagaagcctctgtttgtcatgtagcttgtgatcacgacattgttgcctttggcttgcggcactgcgaagtgagagtaagtgaacgttacatcgttaggatcaagacccatttgcaggacaagaccagttttgttcagcggcttgtaaggccctgttaaagagtttgatacataaccaagcatgtaaatatcgtttgagttaatgccgtcgatcgtcatttttgaaccgcgtgaatcagtgaacaggtaccatttgccgttcattttgaaaacattcgcgcgctcaatttcatcagttaccgtgtttgaagtgatcagcggcttcatgacttttttcaatgtgtaatcatcgtttaactctaccataccgagggcgccgttcgctaattcagcatcgcgttttttagcgctttgctgaagcttctgactttctttacggaagaagtttgtgctgccgccgtagtacgctttgttaaataaagattcttcgccttggtatccgttttctgttcctgtgttggcttcgaatacaaggtatttatggcctttgtcttcaacgtagtgagggtctctcagcgtatggttgtcgccggatgtatagttcccttcatcgataaactgctgaacgttttgatatgtttttccgtcgccgtcaaaaatcgttttatgatcttccactccgttgatcttgagcgtgtcatcagattttgacacatttacctgcgccgttgtcaggctttgtttgctgtaatgtttaccggaaaagtcagtgtagaataaacggatttttccgtcagatgtaaaggttgcagaaccggaccattcttgtgtctgttctttcaggatttcatcgttggcgtcgaacttatcgctgtctttaaagacacgccccgcgtttttccagctgtcgatcgagttgtcgccgactttttggtaaaacatgtagatggatgtgtcatcagcgtctttcgggcttcccgcaagagcaaacacgacgtgatagccattgtattcagctactgttccgtcagcgttttggagcggccagctgtcccacacatccagtcctttcgcggactcgatatttttaattgttgattggtcgaattgaggaacttggtatttttcactttgctgctgtttagggatctgcagcatatcatggcgtgtgatatgagagacgccgtacgtttctttgtaaggtttttgggtattttctttcgcgaaggcttgagtcgctccccctgccagaagtgcagtcgtaaaagttagaactgtggctcgttttgcaaattttttgatgttcatgttcatgtctccttttgtatgtacctttttttgcgatctgccgattcgatcctcctgcattcatggatggcaggtttgttacagaaaaaaagacctaaaatatgtatggggtgacgccaaagaatacactttgcccttaacacattttaggtcttgcctgctttatcagtaacaatcctgcatgatttacttgtcgacatcattctattagactctgattctattgacaactggtctattttcctcttttggatgatagtaaaatgaaaaaaggccttttaatatatgggtaattgagactaaggggtgctctgggcctaggaaaaaacctctctaaaaaagagaggttattttttcttgatagataataaagcgatggtagctaaaatcagcaaagtacccagccattctgatattccgaagggaacatgcagccagataacagctaaaaaagctgccgacagcggctctgcacaggcaagcaggctggtttcagaggcactcagatatttcaggctttccaagtagcaataaaaagcgatgagcgttccgaaaatgatgataaacacaatcgcggcatatgcaggaaaggaccactcgccttcaaatgtccagggcgggcggatcaagctgagggcggctccgccgatcagcatgccccatccgacaacaatagcggatccccatttcttcagcagacgatgcggctgaagggtgtaaaacgccagtgcaaacgccgaactgattccccaaaagacggccagaccggatatggacaggcttccggcattcccgtgcgtgaccaaaatgaatgtgccggcaaccgccaataagacggcgagcagttcttttcccgaaggtattctctttgcgcgaatcgctaaaaagcatgtaatgatcgctggccctaaatactgaagaacggtagcagcggccgcgttgccgtactcaattgccgcgaagtaggtgtattgaacgcctaacattccgaaaaccccgaataaaagaaggggaattctgtcccgtctgtctttccaaacagcccatatccgtcctttttctttgcggtacgcgatgccgagcagaagcgcccctgacaccagaaggcgcactgaagtcagccattctgtattaaaatggcggtgctggaacagatactgggcaaccgttcccgagaccccccataagatagctcctgtcagcacaagccaaatgcctgttgttcgtgaataagaaagagcagcgtgtttttccaggatagacacccccgattctgatgttgtgatattgacttacaataattaggtaaacgaacgcctttcatgtgatatattatatattgtatatcaaattccgtcaaaatgattttcggagaaagcgcttacgaaacggccgtctgatgaatgagcaataaaaaaacaccccggcgggtttccggggtgttttggttattctgcaatcgcgtctgttaaaacaggaacgacttgtttctttctggatacgacgccttttaaaagagccgtgttgttttctaaagtcacgttgaatgctttttccacttttgacgcttgatcaccgatggcaagcgcaagggaatcgttttccagaatatccgtaatcacgagaaggaacaggtcaaggttcttctcagcaattacttttgaaagggccgcttctaattccggctgccgctttttcacatcttcaatatcaactgtgttgacttgggcgatttcgacttttttgctgccgagcgtgaactctttcgcatcaagagaaatcagttcttccaccgtttttttgcttaagtcggcgcccgctttcagcatgtttaagccgtactcttccgcatctacgccagcaatttcagcaagctcttttgccgctgcgatatcttgctccgtgcaagtcggagatttaaataacagagagtcggaaatgattgctgacagcatgaggcccgcaatttctttctcgattttcacgttattttctttgtacattttgtttaagatcgtagccgtacagccgaccggctcagcacggtagtaaagaggttccgctgtttcgaagttggcgatacggtggtggtcgatcacttcaagaacctgaacgtcttcgatatccttgatgctttgctggcgttcattgtggtcaacaaggatgacgccgtttacttcgtttgcggctgtttccaccaaacgcgggctttcctgcttgaaataatcaagcgcgtattgtgtttcgccgttgacttgtccaaggcggacgggctcagcattgaagccgagtttattttttagatcagcgtaggcaatggcagagcaaatggtatctgtgtctgggttttgatgtccgaaaataagaattttttccataataactccttgtccttttttgtagtgtaaacaatctttttatagtttaacacgtcttgcggagggtgtaatcttcaaaaccttaaaaattgatgtgaaaaagaagcatttttgttgagcggtgaggaggattgcgagtaaaatactgggtaagtcagatgctaatcagcatatagtatcaaaaaaggtactatggaggatgaaaaatgaacatatatccgaataaagaaggttgtccggttgaactgacgctttccgttatcggcggaaagtggaagggtattttgttttatcatatgatcggcggaaaaaagcggtttaatgagtttcggcgcatttgccccagcattacgcagcgtatgctgacgcttcagcttcgcgagcttgaggcggacggcatcgtgcatcgcgaggtatatcagcaggtgcctccaaaggtggagtattcccttaccgaattcggcaggtcgctggaaccgatcgttttgcaaatgaagaaatggggagatgccaaccgggagtttctcgaggcataccgggaaaaaacgtctcctcaagatcagtccgctcaaaaataagaagcagcaaaggattaaattccttgctgcttttttttatttcatcgcgatggcctttctggcgttgcgcacgtcattcttcagcaattcgctcaggttgtaagccggatattgaccgcgttcttccatatactcaaagaccatttggtgccacttgatggacgcgtttaagtgcttgacgaaaacatgtcttaattgaggtgtggccgtctctgtaatggctccggcgtaattgcggacagacgttttggccagaatgagcaggccgccgctgtaaaaggaggaatcagcgcgctcttctgtttcatcctcacgaaaagcgggagcttcagggaagaaaggaagcagttcacgcaggttttgttccagcgaatggatggaaaatctgtaaagctgttttaatctggcatcgcttacgtcccgctctgttctttttaatttcacaagtccgtttgcctggaaagctactaactcatgcagttctaacgtttcatgccatgctaatgttctccgctcagtcatggtgtaagaatctcctttatccttcattttcactttcagcatatgccccggtcccgatgttgttcctgatgttttgaagtttccagaaagggaaactcaatgtaaaggaaatacgaaatagaggtgaaactatatgtgggacatgataaagaacttcttccttttcagcagcggggttttgcaggcgaccactctcttacttatcgttatcgtcttgttatatgtacgaaaaaccaaaaagaaaaacagagatacttctggtttcatggatgatcaggatcactgatacaacgggcattctttcactgggatgtccgtttgtctgttttcatgtttcacatggaacattgcgggtgtccgcgctcattttacttgcgatttcgacttatgttaaaatatatacgtgtattttggagagtttatggaaaattcaggtcttgaaagagacattgcggcgtcaaaagagcagtcgtctaagtgctcttttctattcgtatgttcgaatgatacaaggtttgaggtgagtaagtgaaaaatacaagggctctaatagaaggcgccattttgatcagtatttttgcaatcatttcccttttggtcgtgtacctccctttactgggggcaattcttctctttgctttgccgctgccgatcattctttacaccattcggcacggtctgaagcccggggtatggatggggcttgccagccttcctgtcagctttattgtaagttcgtttaccgggcttacaggcgcttttacggctgcctgtacgggaatcgccatgggatattattttaaaaagaaacagcccggctatgcggttgctgccggcgctatggcgtatgtgctgtgcggcgtcgttttttttgtggtcagcatcgtgtttcttaatatgaatgtgatcgataccaccatgtcccagcttcgggagtcgctgtctttagcagaaaccatgtcaaagcagctcggttacggagatcagttcgggaagcagatcaagctgatggaaagtcagctgagcacggttcaatatctttttccgacagtgctcgtattgaccggcatcgttttttctttcctcagttatgctatggcaaggccgcttttacggcgattttcccctgatcttccgaagatgaagccttttagagagctcaaactcccgcaaagcgttgtcattctgtattttattgtgacgatattagggtttctgcctttagaaaaagggcatatgctgtattcggtttcattgaatgggggatttattctcagcttgctgatttgtattcaaggattagcgtttatttttttctattgccgcgaaatggagatgccgaaagccgttcctgttttagcaattgtgctgggtgtgctttttccgctcatcttgtccgtgtatctcctcttaggcatcattgacataggctttaacataagaaataaggtgacgcgaaattgagtgtgacttacaggtggggagttgatagaaatgcctagtttttatgaaaaaccgttgtttcggtatcccatctatgcattgattgcattgtcaatcatcataatcctcatcagcatttactttaactggctgataggagccatcggcgttgtgctgctcgccgtgatcctgtttttcattaagcgtgcggattctctgatcagaaaagaaattgacgattatatctccacgttatcgtatagattgaaaaaagtaggcgaagaggcattaatggaaatgcctatcgggattatgctgtttaatgatcaatattacattgagtgggcgaatccgtttttgtcttcctgttttaatgaaagcacactcgtcgggcgctcgctgtatgacacatgcgaggccgtcgtgccgctgatcaagcaggaggtcgattcggaaacgatcaccttgaatgagcggaagtttaaagtagtgattaaaagagatgagcgcctgctttatttctttgatgtgacagaacagattcaaattgaaaagcagtacgaaaatgagagaaccgtgctggcatatatctttttagataactatgatgacgtcacacaggggctggatgaccaaacgagaagcacgatgaacagccaggtcacctcattattaaatgcgtgggcgcaggagtacggcattttcctgaaacggacgtcctctgagcggtttatcgcggtgttaaatgaacacattttaacggagcttgaaaacgcgaaattttcgattttggatgaaattcgagaaaaaacatccgttcatactgtatctttgaccctcagcatcgggatcggcgcatcggtttcttccttgaaggagctaggagatctggcgcagtccagcctcgatttggctctcggccgcggaggcgaccaagtggcgatcaaaatgccgaacggcaaggtgaaattttacggcggcaaaacaaatccgatggagaaacgcacaagggtgcgcgcccgggtgatttctcacgcgctcaaggagattgtctcagaaagcagcaatgtcattatcatggggcacaagtttcctgatatggacgcagtcggagccgcaatcggaatattgaaggtggcgcaggccaacggcaaagaaggctacatcgtcattgatccgaaccagatcggatcaagcgttcagcgcctgattgaagaaattaaaaaatatgaagagctgtggtcgcggttcatcacgccggaagaggcgatggaaatttcaaatgacgacacgctgcttgtcgtcgttgatacacataaaccgtcccttgtgatggaagagcgtctcgtgaacaaaatcgagcacatcgttgtgattgaccaccaccgcagaggcgaggaatttattaaagacccgctgctcgtttatatggagccatacgcttcatccaccgcagaactcgtgacggagctgcttgaataccagccgaagcggctcaaaatcaatatgattgaagcgacggccctgttagctggtataatagtggatacgaagagtttttcccttcgcacgggctcgcggacgttcgacgccgcttcttatttgagagcgaaaggcgcagatacggttctggtgcagaaagttctcaaagaatccgtcggttcttacatcaagcgggcgaaactgatccagcatacggctctttataaagaacatatcgcgattgcttctctgcctgagaacgaagaggagtactttgaccaggtgctgattgcgcaggcggctgattccctcttatcgatgagtgaagtggaagcttcatttgcggtagccagacgggatgagcatacggtgtgcatcagtgcgagatcgctgggcgaggtcaatgtgcagattattatggaggcgctggatggcggagggcatttaaccaatgcggcaacccagttatcgggcatttctgtctcagaagcgctcgttcggctgaaggaagccattgatgaatattttgagggaggcgttcagagatgaaggttattttcttacaagatgtaaaaggtaaaggaaaaaaaggcgaaatgaaaaacgtagcagacggttatgcacataactttctcattaaaaaaggcctcgctgtcgaagcaaatgcgacaaacatcagcgcattgaaaggacagaaagaaaaagagaaaaaagaagcgattgccgagcttgaaagagcgaaagatttgaaagaaacgcttgaacagctgactgttgagctgagtgccaaatccggtgaaggcggccgtctattcggatctgtcacaagcaaacaaattgcagaagcgctgcaaaaaacgcataagattaaagtggataaacggaaactggagctccaagacggtatccgcacactgggatatacaaacgttcctgtaaagctgcaccctgaagttcaggctgtgctgaaggttcacgtaaaagaagaagcgtaacacacaatgaaaaacccgccgatccggcgggttttttttatgtcagcagacggcgcagcgcaagaaaatgatgagattgtttcatttccgatcgctaccagattgcatattatattacatcataacgaaggatgtgtcggtatgaaacgatttttttctgaaacatattttaataatccggagaataaaaaagcgctgaaacactatccgctgatcggagacggaaaagacggggaggtctatcgcttaacacacaacaaatgcgtaaaatatttttttaaaaaagagacatgtaagaaggaattggaagctttacagctcggatatggttcaccggtgatcccgaaactgtatgaatacggagatcattatattgtgatggaatacgtcaaaggcacctcccttgcgcgccatatcaaaaaagaaaaatccctgtccgtcaaactgacagctgatattttaaacatgctggatgaattaaaagatatcggttttgccagatgggatgccgaaatcaggcatattctgatgaacgaacaaggtgaacttaaagtgatcgaccataaaagagccttttcgaccgttacccgagttcccgtaaaactattaaaaggactggacaaatacggcttggcggatgagtttttgaacaccataaaaaaattaaatccgtcacgctaccgggaatggcgaagggaattgtaagtttctgaaaatccgcatatgtaagtttcctttttttagggtcgtcatatgatatttgtaacatttgtttggtggagtgtggaaaaaatgggagaatatattatggttatcggcgctcatcccgacgatgaactattgggatcagcgggcaccataaaacggctgatcaatgaaggatataaagtgatttccattattacagcattaggaagaaaagaagaagctcatcatattaaacaattgggcgaacgcgcgaatcaagagcttggaattgagaaagtcatctttttggagcatacgaatttagagctggaatgtatccctcttcataagcttgtcaaagaattagagcagctcattcgcgtctatcagcctgaaaaaatctttacacatcattacggcgatgtcaatatggaccaccagagaacattccaagcagttttaacagccgccagaccgcttccgaatcaaaagcctatcgaactgcttacgttcgaaacgctatcttcaagcgagtgggagaggaatacggctgataaactcttcaaacctaattacttcgttaacatcacagacacaatggatgccaaactcgcggcgcttcaccactatgacgtagaaatgagggattaccctcatccccgttcatatgaaggcgttacacatttaggaagagtcagagggatgacggcgggtgtggaatacgccgaagcttttgaagtcgtgcggaggatctggaaatgatcaagacattttccgtcccgtatccgtatatggttcagacgcttgaccgctactacggggtcaaaacgcgccctcaaaaaaaggcggcagtaaagacacagttgaaacatgaacatcatattccgcggttatacaggaaaaaaaagaagttatccattttgattgccacgttttgggactacccgcacacgggcggtttatcaaactatattaaaacgcttagtgaaggcctgaaaaagaggggtcataaggtcgatgtcatctcccctaatctgtttccgtccgcacaggtaaaagaactgcgggcggctgttgttccgaagttaaaagatttctttaaggacagatatggggattataacaatcatattttgaaaaataataggctgatgtttatatacgagcaaatgcttcaaaagattcatttggaaagatatgatgtgtttcatgctcaagatttatttacagccaatatattaggcagattcaatcaaatctataagaaacctttatttttcacaccgcatggcatgtttactttcaacagacttaaatttcacatctttaaaaaaggatcgatagaagagttttattataaaaaactagagatgaaagccattgaatacgcagatcgcctgattattatcagcgatacgttccgcagcccgctcatgaagctcggagccgaacaggaagacatgacaacggtgatcacaggaatcgattacgatgcaaaaacaggcgggaaaagaaaaatcccgctgccgaaaaataagatcatcatctcgtgtattgcaagattaggcccgagaaaaggacataatcatttgcttgacgcactttcacgaattccgtctgatctgcttgaacatgttgaagtgctgatcgcgggcgacggagagatgaggagcgccttagaggaacaggctcgaaaactgaatctatctatggtctcctttttaggaaaaagagatgatgttcccgctattttgaatatgacggacatattcgtactgccgaccattaatgatagtctgccgatttcgattattgaagcgatgttcagcggctcggctatcatcgcgaccgattgcgggggtattccggatctgatccgccataacaaaacgggacttattgtcgaaccgggaaatgcaaaggttcttgcccgggctttagcattttttatctctaacaaatctgcgcgggagaaggctgcttcaaacgcaaaggcctacgcggagaaatatttaagcagtgagacgatgataaaaaatatcgaatcgatttatcaaaataccaacagctcggagggagatcatgaaacatgaacatgcagccgttgtacttgatttcagtgcaaacgggattgggatcattcgcagtcttgcccgaagaggaatcgatgtttacgcgtttgacacggagggaccttatcgtatcggaaaatcaagattggcagattgcgggatatgtcccagccctttaacagaagaggaagaactgctgacatttctgactgatttcgggaagcgattccaagcaaagccggttctgtacgcaggatctgatgattatgcgggatttatatctaaattccgcgagacattagccggtttttttttatttttgctcccgagccgctctctgttagaaacggttttagataaaagcaaagcatatgaattagcggtcaagcatcacatcccctgcccgaaaaccttttttccgaacaaccgggatgagctggaagaggccatcgccaatattgacttcccgtgtattttaaaaccggtggccggccatgaatacagaaaaaaagtaaacaaaaaagcaattgtaatgaaggatgccgcacaattgcgcaaggagttcagctcctacagagaaaatggagaactgctcgtgcaggagatcatccccggagacaaccagtgtttttataaagtcgccactttttatgatgaccaaatgaaattaatgggcctattctctctgcaaaagaaccatcaattccctgctgattttggtgcgggggcccacgtcgtcagcaaacggcttcctgatttaatcgagaaaaccctgccgttttttgaagcgattcagctgaagggagtaggcatggcggaatttaaaaaggatccccgggacaatgtttacaagtttatcgaaattaatccgcgcttttggctcagccatagcctgacagaaccggcaggcattcatttcgtttacatgtactatctgtatttgaccgggcagcatgtgaagccccagctcgaacaaaaagacggaatcaattggatttatgaggtgcgttatttcttaacgtttttgaagaaacgaaaaagaggagaaatgacgttccgggatttttggaaagggtgtaaaggaaaaaaagagtacgctctttttgcttggaatgacccgatgccatttatcagaaacacttggtctcatctcaaaaacagctggaaacggaagcggaaggaagatcggcatgtatgaaaaggagattttgtatggcgcatttcaaaaactgagaattgacgaaaaactgtcgtattcgttcggtgaaagggctgcggtgaatccggatgacatcacatgcctgaaatcaacagacagaagctccatttataaactgtttgtaaagaaaaaatccggcactgttccgctgatattgaaggtatataaatcttcccgtgaaaaaaacaagatcgagattaatatatacgggaaagcccgttctgttttaggggatttgctgccggatatctatcttatagaagaaagtgaccatgaaacgtggatatttatggagtttgtcagccagatcaggggacagcttacatttcacccgaagcatttcaagtatattattccgtctgtcgcagaactgcacagccgcacctttgaaaacaagaatatttctgatggtaaatggcggtcgtggctgccggtatatgaatcggaaaccatgagaaaagggcgtaaaaagcagatcaaaaagacagcggaatttttggatagagcgcttaaagatgagcgcacaaaagatatcgtgaagcctcattatcggcaaatcacaaacttgcttgagcaggaggagccggattttttccctgaattgatacaaaacggctcagccatcacacacggtgatcttcatatgcagaatatctgcacccacgatgcgtccggacatgaaccgtgggatattcaattcatcgattgggaagccgcaaaatacgcgccggtttggtttgatatgacggtgctggttgaaattctgcttggtttcagaaaagattggagccggcacgcagaagatattcgaacgtattgcgtaaaagtgtatacgaaagaaatgaaaaagcggggcattcattttcagacccctcctatgacgctttataaaatggcttatttgcagagaacacttgagaaagggcttcatacccaattgcggagaatcttcgacaatcggggaggagaactgctgccgtatcatgttgacaaagtgtcaaaatggggacgggaattaggattataagtttgagagagggggagcggatgtgaaagaagagatcggcaagccgaacgatctggtgcctctagccttattgcgcgccatggatcaattttacgggatcgaatatcaaggtgagccagagatgctgtattcgttctgtgcggaaggaaaaagctcccccaaacgaaaaaagccattgcgtattctgtacgcaacctttctacgttacccgaatgtcggagggttggcgagctatatcacatcaattaagacgggttttgagcgcatcggtcatcaagcggatgtcatctcgccgctccaaatgccgccatctttttttcaggaagatatcccgcgggccgctgacgagatcagagcgtttcttgttggcagatacggcgccgcaaacgaaaagtttgtgaagaatctcagctatttacatgtctttcaaagatttttgaaggagaaagacttagaacaatatgacctgtttcacgcgcaggatttatttgcggtatttttgctgggataccttaatcaaacgtatcagcgtcctctttttttcacgccgcacggacattttacgaaaagccggatgaagtttcataaaatccaaaagggttcaatagaagaggcatatttcagtgaaatagaaaggcagggtattcgggcttcggataaaatcattacaatcagcgactcctttcacgagcccttgctggagtacggagcgaaggaggctcagctgacgactgttcataccggcattgacattcaggatgcccctgagtccaaacgtgctgaaaagctcgtgattgcgtgcgtttcccgtctgaccgagcgaaaaggacatgatgtgatgctggacgctctcgcccgcatccggcaccatttatccggagttgatatatggatcatcggagacggaaacatgagagggtttctggaagaaaagaaacggaaactgggcctctcaaatgtgtttttcttcggaaaacgacgtgatgtgccggcgcttttggctgaatcatctatatttgtcctgccgacattgaatgataatttccctatagcgatcatcgaagcgatgttctcaggtcaagccattgtcgcaactgactgcggaggaatccctgagatgatccggcatgaggacacagggcttatctgtcagcccggcaacagccgcgaacttgctgatgctctcgtaatgctgattacggatcagtctctcagggaacggcttggaaaagaagcgcgctcctatgccggccggcatctgcgtcaggaactgatggtttcaaaaatagaaagtatttatcaatcatttttctgaatgataccggcgccgcatggcaggtgcttcaagagcaaaataaagaggccggcgtttaactatccagcctctttccgaactattttttcatctcatacagagtctgctgactttgttcgcccgggccgcctgtcattccttgccgggctgagcttgtttttccggtgctgtattggtcagctgagatttttgtgccgttctttttaatccatgagacaagctttgtgttgcctgaactgtttccggataataagaaatacttcacttttccatcatcaacaagttttttcagctgtgagacggttaaaatcggatcggttccgttaaagcctccgagtgccatgactgattcattcgtatggatgatataaggcgccgcagtcaccgtggtgagcgttgcaaacagatattcctcacctgtctgatgctttttcaaataagacagcaggcctgtatccacttcagaggtgaacatattgccgccgtttgagcttttcagctgcgggccggattcgggtatgacgctgtttccgccgtaaaggatcggcgtggctgaccagtacagcggcgtgagcatcaacacacacatggtgatcacggtcagttgtctgccgaacggcttgtgtttcatcacaatgagggcagtgacagtgccgagccccaacagtccgaggatgtacatccaagtgctgccgatctggtttgtatacccgcttacgatgaagacctgaaaaccggcggtgagaaagacacccgcaggcagcagccagcccatccagcctttattatgcttgtataaatcatataaggcccgccagccgattccggaaagggctgcgatcggaggcgccagcatgattaagtagtacggatggaaaaagcttgcgatgctgaagaaaccggcggcaggcacaagccatgctgtccaaaacatcgtttctttcatttcctccgcttttttccggcggtttctgtaccagctgatgacggcgccgaacaaaccggtgagcgcaaaaggcagcatccagctgatttgccccgataattcagattggaaaagcctgagcgcacccggggtaccgttgccgtacatgttcatactcatgctttttccgccgccggggccttgtgagccgccgttttgtgccggaggagttccgctcccttgcggtaaggccgcgttctgtccggatggctgccggggcatttgaacctgcccgttttttccctgaggagcgctgccgcccattgccgggctgttcgttcccggaggctgcatgcccatcccttcctgcatcacgctttttccgccggtcatgctgccgtgagaaaggcccgtcgtctgcccgagcagcctttccgtcccgttatatccgaatgccagctccagcacggagtttgtctggctgctgccgacataggggcggcttgatgcggaaatggaatcaacggctgccgcccatgagacggagagcgccaggagaacggctgaagaagcgagaagtgagatcagttttttcttaatggatgtgtgtgatgcaatgagataaaaaagcagaaaagccggaagcacgatgtaggcctgcatcattttcatattaaaggcaagaccgacaagtgcgaatgcggataagagccaaatgattttgccgcgtttcaccgcgcgcatcaaacaccaggaaccgagaagcagtgtaaagacgagcatgctgtcgagattattcgtccggctgacggccgccgcaatcggcgtcagcgccatgacaaaagcggcgattctggccgcgcccgtgccgaacgaaggctttatcatgaaatacagcagcagaacggaaccgagccccgccaaagcctgaggaagaatcacgctccatgtatgtacgccgaagaccaaagcgaaaatcgtttgaatccataaagcgacaggcggtttgtctaccgtgacaaagccggacgggtcaaaggatgcgtagaagaagttgtgaaagctttgcgtcatgcttttgacggcagccaaataatactggttggcggcatcatcctgccaaatgccgtacatattcaaagccgccgctgctgataaaataccgataagaacgatgtccagtcgttttgttttcaatggtttcacctcttttgtgaccccattgtaaaaaataaatatgaaaaagttatgaataaacgataacgatttaaagaatgttttaccaaaattttcttcacgaaaaaaagaggcggaaagccatcgcttccgcctcccgcacatatatatgagagagcggcctttatttgtgatcgttctctttttggatttcagctaatttggcaagcagaatgtgctgaggcatgtgcatgattctctcaagcggcatattcagtgattctgcgagcttttgcgccgtttcggcggaaatttgcagcggtttcatgtgatcactccttccgtttctttattgtactaaaatcagaaatctatcgtaaggggatatgacaaaggaatggaggtttgaaaagcggggctttataacagaatgggggaggttttttatgcaatcgccattgatgttattacagctgaagctggctgattatcagaaaaaagccgcagaactgcggacaattgacgaatttatcatactgaaacagacattgcaggacatgatgaaagtattcgccgcctttgaagaatgggagctgtatcaaaaaacggccgatctcatggcgcagacggtgctgcacatccgtttcatcgaataaggaaaagccctcgctcgggcgaaggcttttcttaaaaggaccgttcttcttcaatgtttttatgctgatcataaatgacaagcttagacgggctgttctctttagccgtctgctccgctttctcgatcgccgcgtccttcgatgtataaagagccgtcggcgccacattttccaccttcacaaaccatccgtccgcatcaacactgggtgttactgcatatgttttcatccttcttacctcccggtttcgatttatttatttgtttcccggcattcggaacggcaaaacacataaccctctcctccaaatacagggaaagtgatatttttctattctttttcatgagaaatggtaaaatggagtttggatattttttaaggagaggacggtgcttagcatgacagaccttctgaatgatcggctgccgccgcaaaacatagaagctgagcaggccgtgttaggtgctgtttttttacagccgtctgcgttgacactggcttctgaagtgttgattccggatgatttctacagaatgtcacatcaaaaaatttacaatgccatgctcgtgctcggagaccgcggtgaaccggttgatttggtcacggtaacgtcagagcttgcgaataccgatttgttagaagaggtgggcggcgtttcttacctgacggatatcgcgaattccgttccgacagcggctaatatagaatattacgcgaaaatcgttgaggaaaaatccattctccgccgtttaatcagaacggcgacctcaatcgcccaagacgggtatacgcgcgaggatgaagttgaagatttattaagcgatgcggaaaaaacgattatggaggtcgcgcagcgaaaaaattcgggcgccttccaaaatattaaagacgtgcttgtgcaaacatacgacaacattgagcagcttcacaaccggaaaggcgatattaccgggattccgaccggctttatcgagcttgaccggatgaccgcgggttttcagcggaatgatctgatcattgtcgcagcccgtccgtctgtgggaaaaacggcgtttgccttaaatattgcgcaaaacgtggccaccaaaacggatgagagcgtcgcgatattcagtcttgagatgggtgccgagcagcttgtcatgcgtatgctctgcgccgaagggaatattaacgcccaaaatctcagaacgggtaatctgacggaagaagattggggcaagctgacgatggcgatgggaagcctgtcaaacagcggtatctttatagatgacacccccggcatccgcgtcagcgaaatccgttcaaaatgccgcagactgaagcaggagaacggattgggcatgattttaattgactacctgcagctcattcagggaagcggccgttcgagcgacaaccgtcagcaagaggtatcggaaatttcacgggcgctaaaagcgctggcgcgggagctcgaagtcccggtcatcgccctgtctcagctctcccggggtgttgagcagcggcaggataaacgtccgatgatgtcagatatccgtgagtcgggaagtattgagcaggatgccgacatcgtcgccttcctgtatcgtgatgattactatgataaagaatccgaaaacaaaaacatcatcgaaatcattatcgccaaacagcgtaacggcccggtgggcaccgtctcactggcttttgtgaaagaatacaataagttcgtaaacctggaaaggcgctttgatgacggcggtgttccggcaggtgcgtaaagcctcaagcaatgtcttgaggctttttttcatccgaaagaatgagagaatgccgtccgttcggcagacgaaaaaaagaaagcgcttttatataatggcattaagggagggatgatgatgacaattgaatttccgcattttcaagcggcccaaatccggattgcccggccgaccggacagcttaaggaaatcatcaggttttatgaagaaggcctcggattgaagagaatcggcagtttttccggacatgagggctacagcggcgtcatgttcggcctgccgcatacgcaatatcatttagaattcaccgaagaaaccggctcgtctcatccggcgcccgttccgcacggcgacagcctgcttgtcttttacattcctgatcagcaggaggtcattcgcatcagcacgaaattaaagcagatgggatatgaggagaaagaacccgaaaatccgtactgggaagaaaaaggcgtgaccatcgaagatcctgacggctggcggatcgtcctgatgaatacaagcggaatataaatgactgtctgaagaacctgggatacgggttctttttcatgttaaagtatgaaagtttcgggagtaatagatagcaaatgaaagagaaaacgcttttaatcaggtttaaggcgaacaaatatagaataataagatttaaacgttcggatttacgattgactttctgtttcggcactgatacacttaatttgtttgaatgagatatcgttttgaaaggttaacggaggtgcacggatatatgtcttcagtagtcgtagtaggtacgcagtggggcgatgaaggaaaaggcaaaattacagatttcctatcagaaaatgcagaagtgatcgcacgttatcaaggcggaaacaatgcaggacataccatcaagtttgatggcgtcacgtacaagcttcatttaatcccatcaggaattttttataaagaaaaagcgtgtgtcatcgggaacggaatggttgttgatccgaaagcgctcgtaacggagcttgcgtatcttcatgagcgcaatgtgagcacggataacttgagaatcagcaacagagcccacgtcattcttccataccatctgaaactggatgaagtagaggaagaacgcaaaggggccaacaagatcggcacaacgaaaaaaggcatcggacctgcttatatggacaaagcggcgcggatcggcattcggatcgcagacctgttagatcgcgacgtgtttgcagaaaagcttgagcggaaccttgaagagaaaaaccgtctgcttgaaaaaatgtatgaaacggaaggcttcaaaattgaagatattctggatgagtattatgaatacggccagcagattaaaaagtatgtatgcgatacatccgtcgtcttaaatgacgcgctggatgaaggccgccgcgttttatttgaaggcgctcaaggggttatgcttgatatcgaccaagggacatacccgtttgtcacttcatccaacccggtcgccggaggggtgacgatcggttcaggcgtaggcccgacaaaaatccagcacgtcgtcggtgtatctaaagcgtacacaacccgtgtcggtgacggtcctttcccgactgagctgaaagatgaaatcggggatcaaatccgtgaagtcggacgcgaatacggcacaacgacaggccgtccgcgccgtgtcggctggtttgacagcgttgttgtccgccacgcccgccgcgtcagcggaatcacagatctttctctgaactcaatcgatgtgctgactggcattgaaacattgaaaatctgtgtcgcttaccgctacaaaggtgaagtgattgaagaattcccggcaagcctgaaagccctcgctgagtgtgaaccggtatatgaagaaatgcctggctggacggaagatatcacaggcgcaaaaacattgagcgatcttcctgaaaatgcgcgccattatttggaacgcgtatctcagctgacaggtattccgctttctattttctctgtcggtcccgaccgttcacaaacgaacgtcatccgcagcgtataccgcgctaactaagaatttgcagcaaacaagcctccggtcatggaggcttgttttttatgtaggaaaaaaataatagatttttttcaaaaaagtagttgccactttcgaatgttctatgatattataaatctcgttgttacggaacagcttcaatagagtactgcaagaaagcttttgtctcaatgctctatgatacataatccgacacatcaagagccattagctcagttggtagagcatctgacttttaatcagagggtcgaaggttcgagtccttcatggctcaccactttttatggcccgttggtcaagcggttaagacaccgccctttcacggcggtaacacgggttcgaatcccgtacgggtcattgatttactttagcgttattgctaactccttatttgtcctcggagggccgccacgatacggctttccggacaaattactgtaaggtccggtagttcagttggttagaatgcctgcctgtcacgcaggaggtcgcgggttcgagtcccgtccggaccgccattttactttactttatagtatagaaaagaaacatctggctcggtagctcagttggtagagcaacggactgaaaatccgtgtgtcggcggttcgattccgtcccgagccacttacccaaacgcatctgcaatagtaggtgcgttttttctttgttataaaaaagggagagccggcttttcagccggcccagaagaagacgtcaaacaatagacggcgtttattttcgtgaggtttcaaaaaaatattattttttaaaagaaaataaaaaacatgacaaaaggatggcagttcaatacgtttttgcgctgttctctttaatttttttatcttttgacctgaaaccgttataatagacggggaacgtttttcatgatccgaattgtgatcatcatgaaacatcaatagatgaaatgaagtcattctggcaggaggaaaatcaagatgatggataagaaaatccttgtagtcgatgatgaaaaaccgattgcagatatattagagtttaatttaagaaaagaaggctatgacgtgcattgtgcgtacgacggaaacgaagccgtggaaatggtggaggagcttcagcctgatttaattcttttagatattatgcttccgaataaagacggagttgaagtgtgccgggaagtccggaaaaaatatgatatgccgattattatgctgacggcaaaagactcggagattgacaaggtcatcgggcttgaaatcggagcggatgactatgtcacgaagcctttcagcacgcgtgagcttctggcccgcgtcaaagcgaacctgcgccgccagcttacggttgcgccggctgaggaagaatcagcttctaatgacattcatatcggttctctcgtcatcttccctgacgcttatgtcgtatcaaaaagagaagaaacgatcgagctgactcatcgtgagtttgaattgcttcattacttagccaaacatatcggacaggttatgacgcgtgagcatctgctgcagactgtgtggggctatgactatttcggtgatgtgagaacggtggatgtaacagtgcgccgtctccgtgagaaaatcgaggataatccgagccatccgaactggatcgtcacaagacggggtgtcggttattacttgagaaatcctgaacaggactaaccggcgatgaataaggttggtttttttcggtcgattcagtttaagatcacgctgatctatgtgcttctcattatcatcgccatgcagattatcggcgtgtactttgtgaaacaggtggagaattctcttctcaagtcctatgaattatcgttaaatcagcggattgacaatctatcctattatattgagcaggaatataaaggagataatgacagcaccgtcattaaagatgatgtcaaacggattttgaatgattttacgaaaaacaatgaaatacgggagattacatttgttgataaaagctatgaggtcgtcggttcttcgaggccttatggcgaggaaatagcgggaaaacagacgactgacccgatttttaaacggattttctcaacaaaacaggcctattcaaaaaaatattatgatcctaaaagcaaaaacagagtgctgatttcagcaaaacctgtcgtcacagagaatcaggaagttgtcggcgcgatttatgtcgtggccagtatggaagatacctttaaccagatgaaaaccgtcaactcgattcttgcttcaggaacaggcttagcccttgttctgacggcccttctcggtatatttctcgcccgcaccatcacccatccgctgtcggatatgcggaagcaggcgatggaactggcaaaagggaatttctccagaaaggtgcggaaatacgggcatgatgaaatcggtcagctcgcaacgacgttcaaccatctgacgagagagcttgaagatgcccaagccatgacggaaggggagagaagaaagctttcttccgttatcgcgtatatgacggacggtgtcatcgctacgaatcgcaatggagctattattcttttaaacagccctgcgcttgagctgctgaatgtttcacgtgaaacggctttagagatgccgattacgtctttattgggcataaaagagaactttacatttgaggatttagtagaacagcaggattcaatgctgctggagatcgaacgtgacgatgaaacgactgtactgcgggtgaatttttccgttattcagagagagcacggaaaaatcgacggtttaatcgcggttctttatgatgtcaccgaacaggaaaaactcgatcgggaacgcagagagttcgttgccaacgtgtctcatgagctgcggacaccgctgacgaccatgcgaagctatttagaggcgcttgcagagggcgcgtgggaaaacaaagatatcgctccgcgtttcttaatggtgacccaaaatgagactgagcgcatgatcagattggtgaacgacctgcttcagctttctaaattcgacagcaaagattatcagtttaatcgggagtggattcatatgatccgctttatgtcactgattatcgatcgtttcgaaatgacgaaagaacagcatgttgaatttatccgcgagcttccggacagaaatctgtacgtggagattgatcaggataaagtgacgcaggttctcgataatatcatttctaacgcactgaaatactcaccggaaggcggacatgtcactttctcagtcgatgtgaatgagaaagaagagctgctttatatcagcgtaaaagatgaaggtatcggcattccgaaaaaagatgtggaaaaagtctttgaccgtttctacagagtggataaagcgcgcacgagaaaactcggcggcaccgggctcggccttgcgattgcaaaagagatggttcaggcgcacggcggagacatttgggccgacagtgtagaaggcaaaggaacgaagattacatttactcttccatataaagaagagcaagaggatgattgggatgaggcgtgaaaatataaaaacagtcatactgtcagtgctggtcgtcattagtcttgttttaacatggggaatttggacattccagcccaatttttcagaaggcacggcctcaaccaaatcgactgtccgggaaaagcataaaattgataaaacgagccaaaaagtgtcacaaacggtaaaaccccgggatatgtttattcatacaaacggctctcattacaaagtgaatgatgagacgctctttaatgacctgtgggcggatttgccgcaatgggaagtaaaagggatgaaggatatttccgatcaatacgacaagctgggttttaaaaattggctttacggcagaaacggcaattcggcaaagctcgatctgcaattcaatgacaccattccgattgatttcttccaaacgatgtttaaatggtcgaatccgtcaatggaatacagctcatttgaccatattgtcattccgtttaatgagaataagacaaataagaagatttatatggtctcatacagcaagcagctgattttggaagtgactgtggaatcggcgaattaccgcaatctgatgaatgagctgtacagcaaaaagtcgagtatgccgttataccacctctattcggtcggaaaaagcaaagaatttctcatgccgaatgcgcggtttaatatgaaggaaaaagaatttatcactgaaaccattaagacgaacctgtttaagcagacgctttttaatgatccgagcacggtcagagaagacccgaattacaatcggaatgtgctgactgacggaatcagccgtctggaaatcaattcgacacagcggcagattcaattccagcatcggaacctggcacaaagcgcttcttatcaaacaggcgagctgattaagaaaagttataaatatttagaggatacgggaagctggacggatcattatcaatttttcaatgtgagtgataaccagcagctgagtttctacatgtttaaagatcaaatgcccgtgatcaacagcacgtctaagcctttcggctccggacctgttttgaccctgcaatgggccaatgacgaggttctcagctacaagcggccgaactatgttctcggaccgaatccgattaaaacaaaagacgtaaaaatgatgaacggcaatgaggttgtgtctctgctggagcagcaggataaatacgacgtgaataaaatcgaccagatcttcctgtcctatcaaatggtttcttcatcaacgaatgatctcgttgaactggaacccgtctggagtatgaaaatcaacgggaagatcgtcccgattacgaaagatctgctggggaaggaggaggacgataatggagtggaataagacaaaaacgatcttcatcattgccttcctcatcctcgatatttttctcggctatcagttttttgaaaaacgctcgagcagtgaatacgaagtgattaaaaattcaaacgtggaaaaagacatggaaatggatcatatcacattcggcaacctgtcttctgattccgcgacgggctaccggctgacggcgggccaaaaggtatttaccgccgaagatattgatgctttgaaagatcaaaagcctttaatggagatgccggcggatgatcacaaggttacgacgctgaaaatgaaatttaccgatccggtcggtttatcgaagcaaaaaacgcaggaggatgcggaatcgctcgtcagctctaaagtaaccggcggtgaaaaatataaactgtggaaagtcgacaaggataaaaaacagatcattttttaccagatgtatgacggccagtttatttatcaggattttgactcgtccacggatgcgatcggacaggtgattctgcatctgaacgataaaaacgaggtcgtatcttacgagcagaccatgctggagtcattcaagcgaatccagacggagaacctgattcctgagctggatgcggtcgaattattgtattctcaaaattacttaaaagcgaattgcgccgttaaaagcgttaagttcggctatattgcccaatatccgctgacaagtacgcaggtgctggcgccggtatggagaattacaattgaagataagtcaaaagggacgaagaaaaagacactgcaaacgtacactgtgaacgcattggaaagcacagtcattgataacaatcaaaataaataatggagtgagacacaatgggcttgcaatttagcgtgcttgcgagcgggagtaccggaaacgcgttttatctggagacagaggagcactcttttctggtggatgccggcctgagcggtaaagcgatggacgggctgatggagaaaatcggccgcaagatagacgacgtcgacggcatctttgtcactcatgagcacagcgaccatattaaagggctcggcgtcattgcgagaaagtacggtcttcccgtctacgcgaatgaaaagacgtggaaagcgatggagaatcagatcggcaagctggataccggacaaaagtttttgttcccgatggaaagcgtgaaatccttcggcgggcttgatgttgagtcattcggcgtctctcatgacgcggctgagccgatgttttatgttttccactaccaaggcagaaagctcgcgctgatgacggacaccgggtatgtgagcgacagaatgaaaggcattatccgttcggccaatgtgtttgtgtttgaaagcaaccatgatgtcggcatgctgcaaatgggcagatacccttggagcattaagcggcggattttaagcgatgtcggccacgtctcgaatgaagacgcggcgctcgccatgactgatgtcatcggcgacggcacatcgcgcatctatttggcgcatctgagccaggacaacaatatgaaggaactggcgagaatgtccgtgcagcagacattggctgcgaaaggatttgtcgccggggaaacgtttcagttatttgataccgatccgaaaatcccgacgccgctgtgcgccgtgtaatttttccaaatgaatcatgattattaatccgcgatctgacccacactataagcaaatcgagtactcttgaaaggatttgagatagggtggattataatcgcgatgatgaacagtacgcctccgaacagccccgccgcagcaagagagggtactttctatcaagtctgatcggcgtcatcgtcggggccgcgctcatggctttcctgctgccgtactggacaggcggagaccatggagaaagcagcaaaagcaccagccagcgtctcggcagcgaacaggtgaaaacagtcaacgtaaatgtcaacgatgctgtcacgaatatggtcagccgtgtatcagattcggtagtcggtgttctcaatatccaaaagaccgatatttggggagagggcggcgaagcgggaagcggatcgggcgtcatttacaaaaagaacggaaacacttcttatatcgtaaccaatcaccatgtcattgcaggtgcgactgaaattgagatcagcctgaaggatggctcacgcgtgcctgctgaactgatcgggagcgaccgtctgatggatcttgccgtgctgaaggtgaagtctgataaaatcaaatcggccgcccagttcggcaattctgatcaggtcaaagtcggagaaccggtcattgcgatcggaaatccgctcgggcttgaatttgcgggatcagtgacacaggggatcatttcaggcacggaaagggcagtgcccgttgactcaaacggcgacggacagccggattggaatgcggaagtgctgcagaccgacgccgcgattaatcccggcaacagcggaggcgctttgatggatatatcgggcaaggtggtcggcatcaactcaatgaagatcgctgaatccgccgttgaaggaatcggcctgtccatcccgtcaaagcttgtcattcccgttattcaggatttagaaaaatacggagaagtcagacggcctttcctcggtattgagatgaaatccttaacggatattgcgagctaccattggagccagacgctgaaacttccgaaaggcgttaaaaccggggcggtcattatgggtgtcgatgcgttttcaccggccggaaaagcgggtttgaaaaagctcgacgtgatcaccgggttcgacggacataaggtcaatgacgttgtggatctccgtgagcgcctgtatcgcaaaaagatcggcgaccgtgtgaacatcacgttctaccgttcgggaaagaaaaaaacagcggaagtcaaactgacagaagcggatcgattacagaaataaaaaaacagcccggacatccgggctgttttttattgatttatttgttaatattatactattatgaaaacggggaggtgaaacacatgaaaacggctgatgtgatcatcgtattgaatgaaattgaaggtgaatgtgaaggaagaattattttagaatgcagaatttaagaaaatgaaacatgtcatatcaaacgtcctttttcagggcgctttttttatgccttttttcagaagccataaaaaagaactgaacgtgggtcacaacacgttcagttaaaaatgggtatatttagaaaaaggtagacatgaacttagaactttgtgattgaaacagactggtgctgctgaattgaagcggcagatgaaactgccggcagcttattttttgttatttacagatggctccgttttgagcgtttactttcaccgtttgttccgtatggttttgggcagtgattttcacgatgtacttgtagacgccgttttctttcttcatttcagacgatttcacagcgcctttgcaatggctgagcgcgatggaatgcgcttttttagaagcgatcatcacttgttttttctgcacttcttctttcaggatttttccgcttttgccgtccatgtggagcgtatgaagcttgccgtcctggccgaatatgctgacaacatagactgatacgccgttttcttttttcatttgagcggatttcacagcgcctttgcaatggctgagtgcgaacgattccgcttttgcacgggtcatgtgttgctggttattctttatatcatgtttgacgattttgctgtttttacaattgatatggaatgtgtgaagcttcccgtcttgtcctgacacctgaaccacgtaaaccatagcgttatgttcggtcttcagctcagaagacttcactgttcctttgcaattcttcacggcgattttttcagcgccggattttgagatgaattgctgtttcttttcaatttgatgtttcacgacttttccgctggagctgttgacattgacggtgtgctgctttccttttacgtcaaggacgttgacaacatatacgtaagcgccgttgacttttttcatttgcgctgattgaacggcgcctttgcagctgcagtttttcaatgcggtctctttcgctttagagatagaaacggaagcctgctgtttcgtttccactttcgtctgcgctgcgtcatccttatgaatgacagccgcatgcgctgaagttaaagaactgattgaaagtatggtccccagtgcagctcctgataaaacttttgtaattcccatcatatattcctccttaaacatttcattgttggcttcccaactaaggcttattgtaaagacccaaactgaaaacaacatgaatctaagctgaaaacttcctgaattcagcggattttcagcttagattcagttttgtttcagataaaagcgaataatagaaggggaaatgaaaaaaataaacacaggctgatacatctaaggagagactgcatcatggataagttgaaaggcatcaaggtgctgattgtagacgacgagcccgccatcattgattttttaacgatggggcttgtcaatgaagggtttgaagtgatgtccgcggcagacgggatgtcggcgatgaatcttgtgaaaacatttcagcctcatattgccgttttggacgtgatgatgccgggaatggatgggcttgagctgtcaaggatgcttaagaaaacaagcaataccgccatcatcatgctgaccgcgaaggatgaagtagagtttcgcgtaaaggcgctgattgaaggcgctgatgattacatgatcaaaccgttcagctttgaggagctgcttgccagaatttacgcaagaatccgcaaccagtttccgcatcttttcgatgaggtggtgctcggccccttccgaatcgatgaccggagcagagagattttttacaatgaacagcctttgaagctgtccgccaccgaatatgaactgctgaaatgtttagtgctccaccacggaacggttctcagcaaaacgaggattctcgatcaggtatggggctatgatttttacggggaagacaatatcgtcgaggtgtacatccgttctttgcgcgaaaagctgaaggacaaagaacacaaggtgattcgcacggttcggggcgccgggtacagggtggatctggcatgaaacggctgtacagaaccctgcgattccagctcctgttcaggtcactggcgattttggccttgctgttatgtttcatcggcggcactcagtacatgtttatgacacggacgatgtatgaaaatcaggcgatcagcattcagagttatatcaattcaatggatcaaagcgtatggaggtcaatcaaaacccttgcccgttccgaaacatcggctcatccgaatttgatttacccaggggtgacggttgcttttatcaatcaatcatacaagatgtctgttttatcagaagacccgcacgcgggggccgctccttctttcccgaaaaaagtgtatcaggatgcgctgacagatacaatggcgcttcactatcaggtggctcacaataaggcgggtgaggaaatcatcgtcgtgtttcaggcgatttccgttgacggcaggcaggcgggagttgtgcagatgagcacgctgacccagcctctgaatgattcgcttttccgccagatcagcattttcgcggtgctttcctttgcggctttggtcatcggactgtttgttttcttgccggtgatccggctcacactcaagccgctgtcccgcattgtgcgtatgatgggtgacattcatgccggcagtctcgataaacggctgccgatcgataggaagcaggccgaaattgagtcattgggcatttccatcaatcagatgctggaacggattgaaacctcttttcaggcggaaaaagaagcgaaagaacgaatccggcagtttgtatcagacgcatcacatgagctgagaacgccgcttacctccattcacggctttatcgaaattttaatgcgcggagcggcggagaagccggagcagaaagaaaaagcgcttcaaagcatgtacgcggaatccgccagggcgaataagctgatagaggatcttctgtttctcgcgaagattgaccaggtgccgagctttgaaatgaaaaaaggcgcattgggagacgtcattttggaaatggaggctcaactgaagctgctcgcgagaaaccggaagctcgagttctttgtcgatcaaaagatagaagccgtttttgacaaagacaaaatgaagcaggtcattctcaatctattttacaatgcggtgcagcatacggatgaagacacgggtgtcatcaccgtctccctgcagaaagacggaggaatcatgcttatgattgcggataacggaacgggaatcgctccggagcatgtgcctcatttgtttgaccggttttacagggcggaaacctcccgatcccgtcaatccggcggcgcggggctgggtcttgccattacaaaaaccattatcgacagccataacggaacaattgaagtgaaaagtgagcagggaaaaggctccgtgttcatcatccggctgccgggataaaccgggaagcaggaagaaatatcacaatttatatataaattccaaattttcaaaaaataacttgtccttttccaaaattgatgataatatctagttattggtaaagggggtgtgtactgatgaagattgaagaacttgatcttgatacagaaacagcaagcttggtgcatcgctgctagtaaagccgtgactcccctcattggggagttattatctttcagggggtatgtcatgatgtcaactgactgtaagcgctggaagtttaaagacagcgtgcaggtgctgacctacacggcgcatattatcattcaatatcgaaaggcgattaagcttgcgcatacgagtgagatcaaagaggcggttgaacggctgatcaccggctgtgaaaaacaagagctttctgatcttctgggagaggaagcgggaaaccagtttttcgacgcgttaatgaaattggatgctttaatagagccatggcaaaacggccgtgaaggccgcatcactgaaaagcagctgtaccattttgagaaatacaaccaaaaccccaatctgatccaaaagagattagacggcagcagggcagcgatcgtgggtctggggggcgtcggaacgatcattcttcaaaaccttctggcggcgggcatgcagcattttattctcattgatttcgatgccgtatcagtacataacctgaacagacaattcgtctataataaatcttctgtaggcaaattaaagatctcagaatgcagagattatattgcgggtatcaatccccatgcggacgcagcactttaccatcaggaaattacacagccgcaggaccttcgtgtgttagatccgtacgaaattgatatcgtcataaatgccgctgacaaaccccataacatttctgaatgggtttaccggtattgtaaggagcggaatatcgcgtttatgaccgggggtgtcggcagcttcagcggccaatgggggcctctgctcacgcctgaatcctatcaatccggcgtcacttatgaaaaaaacatgccggccggacttctgaactgttaccccgatgaaccgatcaaaggttccttaggagcgacaaacggtattatatcctcgtttatgtctcatgacattatcacataccttgcaggcggaagcccgaaatccctgaatacccgcatcggcctggactttgacggccttcatattacagaaacgaagctttctcaaaaggaaagcgctttatgaagacgatgcatcgtacggcgagaaaaccgggcgaccctctgaaaatagaaatcgacacaagcccgatacgcttgaacccattagatacgcaggattacacaagcaagatgatttgcagcattatgtatgaaagcctgcaggacggctataactgccggatcatccgcaaagatccccgcacctgtcaggtggacattcacccggactatttaggtgacgccgagggtgtggttcaaacgatcatctatcatctgacgaaagaaaatcaaagcccccatctcggcagtttcctgaacataaaacaggccgttccgtatgtaaaaggcctcgtctcatccgatcagctcggggtgaacgtaacgggcgaaaaacgctttgaagtcaccttggacgagccgtctgatgaaatagaatccgttttgcagagcagctttctgattccggcgaccgccgggggcgatgtgccggaaaacggcccgtaccgattcaagcgaacgtttgaaaaggggctggaatttgagcggaatccgcaatataaaatgacgcccgcggatcaccgcacggttcagaccatccaatttattttgaatgatgatctggaaaaaagcatcgggctgtacgaagcgaatcaaacggacgtgacctgccacacccagtttcatcattcaaacatgaggtatcggcagtatgctgattttaaagaaaatcatttgccgatgttatttaccttcaaggtgaaggacgacatgctgagaactttcattcagcattattttgataaacaaaagctggccggggatttggggcatatcatcacaccgactgattcactgatcggtatatgggaaagcgggaggacaccgcagaaagatccgccccttttgacaaaagaagaaccggtccgaatcgtttatgccgattattatccgaacggagagatcattgaaaggctggctgatctgtttcggcgggccggagcggacgtatccgtctcccaggtcggtcatttcaatgattattaccatatggataaaagcgggtttgatattgagcttcatttgttcctgccggcttacatgcatgagctgagctatatcaaatatttcatccgcgacatcagcgatccggagaagaaaaaaacgatcattgatgccataggatctgaaaaaaagaaggaactttttgggttattcgagaatacaactcattattgcccaatttgttttgggaaaagtctgtatctgcaagatccatgtatagagggttttagtgtaaagactgacgggctcctttctgttcatgatgttaaatgcagatagctggaaaggggtattcatttgcggaatcgaaatttgctttacttctccggttttttcggaaacttctttttcgaacggggaatttggattttatatttaacaagcatgaattattcattgtttcttgtgggcatcctgcaatcggtcctgaatttggcgatgtttctggcggaagtgccgagcggcgtcatctcggacagaatcgggagaaaaaaatcgctcttgctcggccattttatggtcattatctatttggtgatgttcctgagcttccataacttcatcgccctcttcatcgcccatattatatacggtatcgggctgacgtttatatcaggaacggatcacgcctttttgtttgattcactgaaagaacaagggaaagaaaagtggtacggcaaatccatcggaaactataacggacttgtcatactcggtcttgcgatcgccatgggcatcggcggctacttgcaggaaatatcatggtcgtatgtgtttatcgccgggattgtgactcagctgattgcgatggcggtcattacacagctgacggaaatcaaatttgaaaacagtgaacacgaaacgcagacggtcggggacatcttaaaagaagtcaaagatttcttcagactgaacaaagcctttaaatatctggtgctgtcactctccgttttctttgcgattacatcggttttttatatgtacggacaagatttgttaagtcaggaagggctgtccgtgcgcaatatatccattatttttgcgggactgtccatcttgcaggcgctgtgctccatcttttcttccaagccggcggaaaaattcacgccgaggcgcgtgcttctgctgacattctgcatcatcggggcagcctatctgtttataccttcgggcagcctgtacgtgacgatagccgcttttgtcgtcattaacgcgctctatgatgtgatagaacccgtatccagtcaggtggtgaataatgagattccgtccagaacgagagccacgctgctgtccattatcagtttgatgacctcgctcttcatgttcattgcctttccgtttatcggattcttaacggactattttgattcagctttgctgctgaccgcaatcggggtattatccatcttgttgtcgctgtttatgatgctcagcttttataaactgaaagcgagcgtcgccatccagaataaagtcgagctttgaaccagaatgacaaagggatgatgtgagttgctgaatattcataatcttacggtaaatttagcgggagatacgattttcaaacaagtttcttttttcatcaatgaaggcgaaaaagtgctcgtggccgggccgaacggttccggcaaaagcacgctgttcagggtgctttccggagagcttgaggcagatgaaggaacgattgcgatcaacaaaggggcgaaggtcggtttgctgaagcagatcgctgatccccatgaggatctgacgttgtatcaatatctggaaaaatcgtttgaagctctcgcggcgatccagaaggaaatgaaggccattgagctgaagctttcggaaccgatgagtgatgacgagctgactgctttattggaaaagtacagtcaatacacggaaacatttgagcggaacaacggctaccagatgcatgcgatgattgacgaggtatgcaacgggctcagcctcagcgaattaaaggatcagccgttttcaaagctgagcggcggcgaaaagacaaaagccggccttgctgaaattttaatccgcaacgacgacgttatactgctggacgagccgaccaaccatttggacgtccatgcgattgagtggcttgaagggtttattaaaaaatcgaacaaaaccattctgtttacgacccacgataaaacgtttgccgaccaaacggcgatgaaggtgctcgagattgacgataccgaggtgaagatttggccttacggattcagcgaatatttgaaaaagcgggaagaattcatcatcgcccagtttgagaaatatgaagaacagcagagaaaaatacagaagatgaaggaatccatcgcccagctgagagattgggccaaccgctcgaatccgccgtctgtcggcctgcacagacgcgcgaataatatggaaaaggcgctgaaaaggattgagctgatcaataagccggtccggacggagcaaaaattaaaaaacgcatttcaggaagcgggcgccggttcaaaagatattgtgttcattgaaaacggaaaggtggcgcacggatcttcccttttatatcaaaatgtgaacctgcgcataaagcataaagacagaatcggcatcgtcggcagaaacggcgtcggcaaaacaacgctgatccgctgcatcatcggggaaagagaactgtcggacggcaccattaaagtgggggaaaatcttaagataggctacattgatcaaaagagccacgtcggagattcgagtcagacgattctgcaattctttaaagaaaatctgctgactgaagagggcatggcccggaatatgctggccaagtacggattttacgggtcgtcggtctttaaaaaactttccgtcctgtcgggcggtgaaagaatcaggctgaagctgtccatcttaatggaaaaaaagctgaatgtcctgatcctggatgagccgaccaaccacttggatattgaatctcaggaaattctcgaaaacagcctgatgcagtttcaaggcaccatcatctgcgtttctcacgacagaaacctgctggagaagttcaacaagattttctggcttgagaatcaaaatgtcaccatcttttcaggtccatacagttacgccaaacaaaaaaaacggcagattgccgaataaaaggggaatggatatgaccattgacagactgacaatcaatgagttatcgtacgatctttttgtaagcgagtatgctgataagaaaccttttattttgacgggggcaatggatcactgggaatgcaggccgtggacgcttgaatacattgatgaacactatggagacagaatggtcaccatccggaaatcagatatcgaaggggtcaaaacgtttaaacaagtaaagctttccaactatatcgagtacattgatcagaatgatgacaaatggtactgtgactggaattttacgcagctgaaccaaaatgacttagaccttgtctattccgcacccgagtattttacaaaagacacattgagagcggatgaagaaacgggacgggactggaaatggttctttctcggttctaagcagacaggcacgccgctgcatcaggattttaacagcacgcacgcgtggaacggcgtcatcttcggggagaaggaatggatcttctatcatccggacgactctccgtatttgtacgaaggaaatatcaatgtctttgatgaaaaagacattgagcaaaaaccgctggttcaaaaggcgtctccgatccgcttcagacaaaaggcgggagaaatcatttacgcgccgcgccattggtggcatcaagtcgagaatacggaacatacattggcagtgagtgagaacttttggtttaccggagagcggcttgccaatcagatataaacgaaaggctgaggagcatctcagccttttttgtatggattcatttcatccggtccagcccgaattttttcaggcggtattgcaggctctgtctgctgattccgagctcgtttgccgttttggatatgttattgccgtgttttctcagggttttttcgatcatgtatttttcgaagttttccattttgtcttttaaatcggtgccgggctgggtgcttgcggcggctttagtttccgtgtcagcgggtttgattttcatccggtattggtaaggcaggtgggccgccgtaatcgtcgtttcatccgtcataaagttcatggcgccttcaatcatatgttcaagctcgcgaatgttgcccggccagtcatattccaggaagaatcgctgcacatcgtcactgatcgaatcgacatgcatttggaacaggtggttgtttttctggataaacacttcggccagaggcagaatatcctccttgcgctcccggagcgggggaatgatcagcgtgacaacgcttaagcggtagtataaatctttgcgcagccgctcttctgaaatggcggtgatcgggtcttcattcatcgtggcgatgatgcggacgtcaatcggtttgtcctgagctgatccgatgcgcctgattttcttttcctgaagggcgcggagcagttttgcctgcaggctgagattgagagagttgatctcatcaaggagcagggtgcctccctgcgcctgctcaaataagccgggctggtcgatggctccggtaaaggcgccttttttcgtgccgaataaaatactttcgaccagactgtccggcagggcggcgcagttttgtgagatgaacggggcgcctgagcgctggctgccgttgtgaatgctttgggcgaacagttccttgcccgttcccgtctcgccggccaaaagcaccgatgatgacgtacgggttgcccgtttcgcgttttcgatgacttcccgaataaccgggctgttgccgagaatactgtcaaacgtgtagctgttctgttctttcctgtgcatgttctccctgatcagccgttcgagcttggtgacgtccttggcgatttctacggcgcccttgatttcgccgttttgcacaatcgggaaggtgtggttgatcgtcgtgatttcctggcctttgttattaaaatagctttgcttcacgtttttaatcgttttgccttcttgaagggcctgaacgagcgtgctgtcctgctgattggaaaacataaatacatcagtcaggtttttatgcaggacgtcccgttcatccatatcttcaatctgcatcattttcttattgtaaatgacggtgctgcccttctcgtccaccacatgcagcccgacatcaatctcttccagaatgctttgtaacacgagtgtgtaaaattcgctggttgtgtgcaggtcaattccccctctcaatcgtcttaacattcattattttaaaataaatcgaacaggaaacgcaaaaaaattttgcgcttgaacgatatttaaaaataaatggaaatttagttaataaaaccattgacttttttaggaaaatggttgatatttagatatatacttaaatatctaaatcatgtacgtatgagagggggaaagtttttgaataaagcttttaaagcactggccgatcctacaaggagaagaattttggacttattaaagaaacaagacatgacagctggtgaaattgcggaacacttcgacatgtcaaaacccagtatttctcatcaccttaccatattgaaaaatactgatttggttcacgatgagaggaaaggccaatttattatgtattcattaaataccactgtattacaggatcttataggctggttcttttctctgactgattcagaacatgataataagaaaggcggggaatcatgaaaaaatatttcttttcagcaggaatcatagttttaactgttttcacatgggctttcacatattcatctttaccggacaatttggcgacacactggggattaaacggaagtgcaaatgattaccaaacgaaagctgatgcgatgatgatgcttattggcatcatgattattgtatatattttaatggttatcatccctaagattgatcctaaaaataactacaaaacatttatccggccatatatggctatatttaatacattgtttgcggttctgtttgtcattaatctgatgaccatcttgaccggcctgggatatgatctccctatatcttatttaggaaactttatagtgggagtcattttcatggtgtttggaaactttattcagaaagttaagcctaattactttttagggataagaacgccttggacgctgagcagtgaaagagtttggaaggatacacacagggttagttcgaaaatttttgtctcagcgggcatactcatgatgcttgcagcttttttgccgccggtgtatagagtgtcagtcattttcattgcggcaatcggctgtatcatattatctttactatattcttacattgtatatcagagacaattgaataaataactgttgagtaggagcaatctaattggattgctcctattttgtcagcgggaaacgcaaaaaaattttgcgcttggctgaagtttgcacgcaaactgccggaaaattttgcgggaaaagaaagaatgttggcgaaacatcccgttttttcggattggcacggaacttgctttataaaaagggaaagcaagatctaatgttgaatgattacaaaacaagggggaatcagattatgtcagctttcacaaaatctcaagaaattatcagccaaacttcacattacggcgcgaacaactatcatcctctgccgattgttatttccgaggcgcagggtgtttgggtaaaagaccctgaaggtaatcaatatatggatatgctgagtgcttattctgcggtgaaccaggggcacagacatccgaagatcattcaggcgctgaaggatcaggcggataaaatcactctgacgtcacgcgcgttccataatgatcagctcggtccgttttatgagaaaacagccaagctgaccggaaaagatatgattctgccgatgaatacgggggcggaagccgttgaatccgctgtcaaagcggcgagacgctgggcatatggggtcaaaggagtagcggataaccaggcggaaatcattgcgtgtatcggcaacttccacggcagaacgatgcttgcggtatccctttcttcagaagatgagtataaacgcggtttcggacctatgcttccgggtataaaattaattccatacggagacgcggaagcgctgcgccgggcgatcacgccgaacacagccgctttcttattcgaaccgattcagggagaagcgggcatcgtcattccgccggaaggatttttacaagaagcggcagccatttgtaaggaagaaaatgtacttctgatcgctgatgaaattcagacgggactcggccgcacagggaaaacattcgcggttgactgggaaaatatcgtaccggatatgttcatcttaggcaaagcgctcggcgggggcgtcttcccgatttcgtgcattgcggcgaaccgtgacattctcggcgtgtttaacccgggttcccacggctcgacattcggcggaaacccgctcgcttgcgcggtatcgctcgcatctcttgaagtccttgaggaagaagggctggcagagcgttcccttcagcttggccggtattttaaagaagagctagagaaaattgataacccgatcataaaagacgtgcgcggacgcggcctgtttatcggtgttgaactgacagaagcggcccgtccgtactgtgaaaagctgaaaggcgaagggcttttatgcaaagaaacacatgataccgtgatccgttttgcaccgccgttaatgatttccaaggaagacttggactgggcggtccaaaagatcacaaacgtgcttcaaaacgcgtaaaaccttgatgcggcaatgctttccctcggcttgtatggaatttacaaataaaaaattcagcacactctatttgcgcggcgacagtattttagtataatgtatctttatgtacgaaaatgaatttcatataacattcatatacaaatagaggctctttggacagcaaatcggtttcaaagcaccggcttggttccaatacaagttgctgaaggggtgcagaatagtgaatacaaatcaaaaagagaatcagcttcagcgcacaatgaaatcacgccatttgtttatgatttctttgggcggagtgatcggcaccgggtttttcctgagtaccggatttacaattaaccaggcgggaccgctgggcgcggttctgtcttatctggtcggcggctttattatgtttttgaccatgctctgcttaggcgagcttgcggttgcccttcccgtatcagggtcgtttcagacgtacgcaaccaaattcatcagccccgctttcggtttcgcattcggctggctgtactggctcggctgggcggtgacatgcgccattgagtttttatctgcgggacaattgatgctccgctggtttccgcatgttcccgtatgggtgtggtgcctcgtgtttgtcggactgatgtttcttttgaacgccattaccacaaaagcgttcgctgagtcggaattttggttttccggcattaaaattgtagtcattctgctgtttattattttgggcggcgccgccatgttcggcctgattgacatgaaacacggcgagcaggctcctttcttctctcatttttatgaggatggattgtttccgaacggcattaaggctatgcttattacgatgattaccgtaaacttcgcgttccagggaacggagctgatcggggttgccgcgggagaaagtgaaaatcccgagaaaacgattccgcgctctatccggcagacggtatggagaacgcttgtctttttcgttctctccatcatcgtcattgccggcatgattccgtggaagcaggcgggagtggtcgaaagcccgtttgtcgtggtgtttgaacaaatcggtattccatatgcggccgatattatgaactttgttatcttaattgcgctgctctcagtggccaactcaggcctgtttgcatcgacgcgtatcttatatgccatggcgaacgaaggacaagcctttaaatcgctcggcaaaacaactaaacgcggcgtgccgatgaacgctttgatcgtgacgctggccgtcgcctgcctgtccctgctgtctaaagtggcagcgccggaaaccgtttatatgtttctcttatcattagccggactaagcgcgcaggtcggctggatcacgatttccctgtcacagctgatgttcagacggaaatacatccgcgaaggcggcaaagtggaagacctgaagtttaaagcaccgctgtacccggtgctgcctattatcgggctgacgttaaatacggtcgttctgatcagtctcgcatttgattcagaacagcggctcgccctttattgcggcatcccgttcatggcggtgtgcgttatcgtctatcatctgtatgtaaaaaagcataagcagtcagaaaaacagatagagctttaaatcttttcgtgtccaagtcatctttgagaaacccgcacaggacaacatacaacatgttgaggtggaaaaacggatgaacaagaatatctcagttattggaatgccgatggatttaggacaagcacgacgcggagtggatatgggcccgagcgccatccgctacgcgcatctcattgaacggttatctgacatggggtatgcggtggaagacttaggcgacatccccgtcaatcgtgaaaaactcaaaaatgatgaagatctgaaaaatttgaactctgtgctctcggggaacgagcagctcgcccaaaaggtggacagcgtcattgagaatgagcggttccctctcgtcttgggcggcgatcacagcatcgcgatcggaacgctgacaggaacggcaaagcactataaacagctcggcgtcatctggtacgacgcgcacggcgacttaaacaccctggaaacatcgccgtcaggcaatattcacggaatgccgctggccgtcagcctcggcgtcgggcacgacacgttggtgaatttgggcgggtatgccccgaaaatcaagccggagaacgtcgtcatcatcggcgcgagatcgcttgatgaaggcgagcgtgaatacattaaggaaacaggcatgaaagtctatacgatgcatgagattgaccgcctcggcatgacaaaggtcattgaagaaaccattgactacctgtcagactgtgacggcgttcacctcagccttgatctagacggccttgatccgagcgacgcacccggcgtaggcacgcctgtcgtcggcggcatcagctaccgtgaaagccacttggcaatggaaatgctgtatgatgccgacatcatcacttcagctgaatttgtcgaagtcaacccgatcctcgatcacaaaaacaaaaccggcaaaacagcggtcgagctggtagaatctttgttaggaaaaaaactattataaaatatgcgcctccgcacctgcggaggttttttttgttgccacgaggaaactagcgggcttccaccctctttttggacctgtaaatatgatatatttattacacaaaatgggaaagggaggtgtcttgacagatggctgaagtgatggcccacgaaacagttgcgaaaaaaatcagtgactggtatgaggaaatcaaaaagcacaacactgaatcggctgaggcgttaagagaacaactgcttacggatctgcaaaatatgacacaaaatcaaacagtgctcctttattttaatttaattgattcccgctataagcttttgatggaagagtatgagaaaacagacgacattttaaaaacgatccagctgaacgccgataaagaaaaaacagaccagatgattcaatactattattatttcttttccggaatgcacgagttttaccgtaaacggtttatgaacgccattaatttttaccggattgctgaaagcaggctccggcacataccgaatgagattgaaagagccgagtttaattatcaagtggcgattgcctactatgaaatccgccaaaactactttgcgatgaaccacgcggaaaaagcgttggagatctacaaagccaatgaaatgtacgcggtcagagaagcacagtgtttaatggtgatcggctgtaacagaatggacttgttccactatcagaaagccgaagagctcctgcagacggcggttcatcaagccgccaaagcgggcgatccgcatattgaagcgctcgcccactttaacgcaggcatttgctatgaaagacaggaaaaactggaagaggcgcgggtcgagtttgaaacggctcttgatcaaaaggagcatttgcgatcagcgtattcggtgcggagtctgtacatgctggccagagtgttattgaagcaggaaaagacggatgagggccggttttggctgcataaagcgctgaatgctgctgaagaaaaaaacgagcctgtatacacccaaaagctgcgcattttacagcatgtctttattgaccgcaatgaagaagcgcttgaatcagctttcgccgagttaagaaggaaagagctgtggagtgacgtttccgatttgtcgtatcaggccgcggcgcattttaaaaaacaggagaaatacaaaccggcggcgaagtattttcaggaatcaattgatgccaatgaccaaattttgagattaacggaggggattcgtaatgaaaacatgtaaattcattgtactctcagcagccttggcaagtctcatttcgattggattatttgcgcaaactggttcaacggcacaagtcgaacaaatcataaaaccggcggaaaacggagccttcggataatactgcatgataccgctttcgtgtaaggagtgattcaatggctatcacgctgcagccgatgacaggacaagaatttcagtcctatctcgctcattcaaccaagcattacgctgaagaaaaggtaaaagcgggaacgtggctgcctgacgaagcgccggaattagcggaactggcgtttgaagacctgcttcctgacggcttggagacggccgatcactatttatggacgctgacattggacggaaaggaaaatgccggctggctgtggctgcacgccgatccggacaacccgcagcaggacgcatttatttatgatttcggccttcatccgcctttccgcggcaaaggctatgcaaaagagacgctcgcaaggctggaggacaaagccaaagacctgggtgtccgcaagatttctctccatgtgttcgctcataacgaaacggcgcggaagctgtatgagaagacgggatttctggagacggatgtcatcatgagcaaaaagctgtcatgaaaagaggcccgcacgatgggcctcttttgttattcatctaacaatgtcatcatttgttccggataacgctcgccggccgccgttccgatcggaaacatctcatccaaccgcgccttcacatcctccggaagcacaatgtcgagagcggcgaggttctcttccaagtagtgtttcttttttgtacccggaatcggaatgaggtcatcgccgtttgcgagaacccatgcgagcgcaagctgaggcgcggtgatattcatttcccgggcaatggcggtaagtttttggactagccctatattcaccgccaaattgtctccctggaatctcggcgttcttcttctgtaatcatcggcatccagctgatcggtcgacgtcatctttccggaaagaaaacctctgccgagcggactgtaaggcacaaatgagatgccgagctcacggcaggcgggcagcacatgctcctccgcttccctgctccataaagaatattccgattgaagcgcggcaatcgggtgaatgcggacggcgcgcctgatcgtttctgcggaagcctctgacaatccgatatacctcacttttccttcgtcaatcagctccttcatggcgccgacagtttcttcaatcggcacccgcggatcaacccggtgcagataataaaggtcgatataatccgtcccaaggcgtttcagactggcgtcacacgcttttttcacataatcgggccgtccgttaatttcgataaactcacccttttcgcttcggacataaccgaatttcgtcgcgaggcacagctcctttctgaatggggcaagcgctctgccgacaagttcttcattcgcacccaatccatattgatcagccgtatcaaacaaattcacgccgagatgaacggcatgatgcagtgtggaaatcgactcttcctcactctggctgccatagtattccgacatgcccatgcaccctaatcccattgcggaaacccgcatcgaaccgattgttctgtccttcatatgtcctccccctttcttgtatgataaccggatttcctgatatttgaaaatgatttatgtatatgatttacatattgttataaaatttttaaaaatctgtaagttgtatatttttttatcgcaatttcgtcatataatgaaaacgtggaaaaattaaccttaaagaaaagaggcgaagtcaatgtgtaaaaagctgttcaaagccgtcctcccgtttgccctgtcattcaccatggttctgtcattctccggtttgaatgtaaaagcgaaagaaacagaaacagcccgctacgcaaaagaaatcgcagaccttcagcagggcacgactcctcaagacgttctccaatccgccaaagagcttgccaaacagaagcacgtttcaacagaagcaattctcaagcagtttcatcaagaaatcacggcagacaaggtgcaaggaaatgtaatcacttccaaagaaggaatctctgcaatgggcggatcgtcaggaaccaaaaaacttccgaaaagcacaaaaggcaatatttattacacgaactcatacacggcttattacaatcacgggcatgtcggcatgtattcatccgctgataaaattgttgaatccgtgccgggagacggcgtccgccagattgcgtataacggcagagaagtcgaagacaattcaatcgttcagaccgtgaaagtcactgatgcccaaaaacaagccgccgctgactgggccgtatcaagagtgggtgatgagtactccttcaacttcgtcaataacagaaatacgggccatgaaggcgccaaaaactgctcaaaactgctgtggtcggcattccttttaaaagcggggattgatatcgactctaacggcggcttaggcgtatacccgcgcgacatcacaagctcgtcctacacaaccacgatcctgaccattcactaaggagaacaacgtgaaaaaaatcatctcgatacccttagtgatcatcgccgccgcagcggtcttatgcttcttctatttccccacggaagatcctgcggaggttgcgagagacacattaaatgaccctgattttctgaaagataaagaggcgctgctgtatttctccactgcggctgaccaagacacgttcggcggcggaaaaagctacgccctcttcgccgatgaaaaagggcggctttcttcttatcaaatgaaggggcttgagctcggatcggccaaagtgcatgacgaaagcgtgctgctggaggacaaaaaaggaatctacaccgttcagggcggccttcacacgtataaaagagcgtaccagcatacgggagacagcgcgggatatatcgaacgggcgaaaggcttttacacgctgtataattcgggctacgacaagagcggcggcagctatcgctcagagctgtaccgccagattgacggcagctggaagcaagacgtcatcccgcattacatccgcgcttcaggcttttttaaagatcatcttttcgcactcacgccgacagatgacgaaaaaggctatcacgtccaagacattcaggccgataaagaaaagctccatacaaaatcaatcgcgacatggacgtacaaagaaggcacgtctgtcgaatcccagctcgcagcggacgacagcgccgtctgctttgtcaccagaggggaaaaagcagatcacatctatcaaatggtgaaagtcatgaaaaacagcggcgccatcaaaacgtatgacatcgccgcttataataatgacgaacagacgatctatgactccatgccgttcagcttcaaaaaaagctttttcatggagcggcgcagcttctatttcgttgacggcttcggaaacgtgtaccgtatcaactctgagaccggaaaaagcaaaaaagccttcaagctccccgcatcacgaatgaaagccgacttcaaagaactgacgcatcaaaacggaaagctgtatctgttcacgtacagctacaaacagcccgccaaaatcgagtccttcgacctgaaaacgggcaaaaaactgaacggcctgaccatcccaaacttaaaaaacatcatcacgccgaaaagccatctcaagctgtatgatgtgcaggtgatgggtgggttttgaagagtataaacatatcggaagagcttgccgcttttggtaagctttttataatgaaatgttactgcaagaaagaaggtgttcatttgaaatcattcagtatcttcttattgttgtccgtcatttgtataaccattgtttttgtcataatgaatatgttgattggataccctgatatgagcaacggggcattgattatgattgtatatatcgttgtgacccttatgataaggctatataacaagagaaaagccgaccgaacatagagatagaggaatttaggagggagccgatgaagaaaaagcttgccgcggtgaccgtaaccattctcctggtttccgtaataaccaactcttttttaaacggcggaaagccggactggattgatgtttgctctacactgctggcgtgtctattaggaattctgttcgtccttcgcttagaaaaaagagaaaacacgtaaagagccggatgctgaaaacaccggctctttttgcgcgtgatttgccgaattgtggataaaactcagcccgaagcactactaacatgtgtataaataggttatattgaaaagagaacaattgccgcgtgcaaaagaaaaccggaggacgtaacaatgaaaaccgcttattattcttgtgaagaacatatcgaaaccgtgctggacatgtacatagatgatcatgagcttccgcccgaaatcagaaaaatcgaacatactaacagtttatccacagcctgtgaattatgtggggacactgcaacatatctagtagggaacgaatgatcctacacaaaatacagaaaagatatccacaattgtggacaatatatatgaataacttgtttctaaagtggggatgacctgtgaatatcaatatcgtgacaattggaaaactaaaagaaaaatacctcaagcaaggcattgaagaatacaaaaaacgactttcagcctacgcaaaaatcgacatcatcgaactcccggacgaaaaagccccggaaaacctgagcgaccaagacatgaaaatcgtcaaagacaaagaaggcgaacgcatcctggccaaaatcagcccggacacccacgtcatcgccctcgccatcgaaggaaaaatgaaaacatccgaagaactggccgatacaatagataagctggcgacttatggaaaaagcaaaatcaccttcgtcatcggcggctcactcggcctaagcgacgccgtcatgaaacgggcagacgacaaactgtcattttcaaagatgacgtttcctcatcagctcatgcggctgattttagtggagcaggtttatcgggcgtttcggattaatcgtggggagccttatcataagtgatggtaaacgggaaaatcgaattatctgtcgaaataaacaaatttaatgattattttttaaatataaaacactaggagtgactaaatatggcattaactttagaagtatgctcagaagtcttagctaagagtgctagaacttgttgtgtctgcagagtatttaaaccattacatgttcaggttcaccatatacgtgaaaaggctgatggaggatcagatgattttgataatttgatacctgtctgtatagagtgtcatgcgagtatacatacaaaaacaaaaatgacacaaaatttttctgagaaagaacttaaaaaaattagggatgatgtttatgaattggttagagtaggtcagctccctaaaagtggttcaatagataaaaaagaaattgaattaatatcgtctatattagctgaaacaaataaacttaacagagaggttggagatgaggctttaagtactgaagcaatagaattattgtctaccattctatgtgaaggagaaccagcaacttttagtaaaacaacagaggattcgattcttatagatattggtggacaatatatatttaaaaaatttaatgggaaagcacagtatcctgattttgttatagagttacttgcaaatggtctaataaatacgactggaagtttaattgaaataactgaggaaggtaaacaactaattagtaatttgattcaaactactgctacctacacccaaaagaaagtaaaatgtttcgaatgtggtttacactttattatttgtacatggaataaagatacgcataatagttcaacaattcattgtcctgaatgtgggcagaataatggacatttcttgatatggtcgcaacaaaaattcggttttatatttcaggacgtccctggaaatgctaatgtttatgaagtaggtagattaaattaagattaagtttaatctgaactatttctgcattttctaattcttagttattaggtgaaatttctttgtggaatattttacataggggtatattatggagaagagcagtgcttttgaaattattcctgctgattattcacctgctaaaattgataattccattgctacattaaaccaacccttagctaatatgcttgtaaggatgggactgcctactgaaaatatgttctttcaccaattgaagaaagaagaaaagtcatattctcactagaaagtacgttagaagttttaccttacgacgagcatgtgaaggcattttacttatctaagtagttactgtccgctgtaacgattgggttatttgatggcgctttaaactttttatgggatgaaacgattaaagcagtaagatatcttgtttcaaagtttgatttacaacatttttttaacatagcgcggaagctctctcatcacggtataagcatttacacctagaggaagatttagaggctatatcagacacgatttacttgagatttgtagaagaatcggattaatcaatgatgttactttcaagaggcttgagcatgtcaattatttgcggaatcatgctagttctgctcaccctaatgataacgaaattacaggcattgagatgttagcacttatagaacattgtttgaaatatgcaattacagctaaaccagatcattctgtcatacaaataaaaaccttgcttgagaatgtcagaatcaacacaatacctgaggacgactgtaaattaataggacagttcatttcgaatggaataatttttacaatgagtatccacatgcgaaatctatcagcgattcattacctaaaggggagatcccgagtgccgcaagaaaattatttgttaaagttattataatttgccttgtaggtaatggtatgggccgcagaaggtgtcgatgaaaatgcagagccctattataataaatgttaaatcatttacagtgaggggagtggtagactttctttatctctttgaagataattaatttgttatgtatttacatatatctaacaagattctagaattagagcagtagcaaaatatcttaaaattaaaacgacagatgttcacataaataaggcactagattttatataaaattgcgggaccacttagagagaaggtattttaaaaagaaagcaggttttaaacaaaggcttttatttaaagaaactaaaaaacaactacaggaaatgtaagaagtaaaaaaccatttaaattatcgtattaaaagaaaaatgagtactggaaattaggatgtagagaaaggtatatataatttattttctaatagtgtccattcctttcctttaggtatgagtaattatgatcgtttcaaaagaaataaccatctagataataatcaactttttaccatttctttagaggttaatattatatatctagtttcaattatcaaatcatatataacacttagaaaaagcttaggtagacagttgaacaaatatgaaaaactaattgtcagaaaattagtcagtgatgagtacttaaaaaatggtttgagaaccgaaaaaaagaaggtaaaaagtttaacattctcaattttaataattaaggaatccttttttttataggctgtattaatttgactttttatttcaatattttcaatattggaggtatgttgttattggtatgtttgttctttgtacagttaattctaaatggggtaattaaaaaaaggtaatcaacgtagattaccttttttaattattttcctattggtgaattctctttgtaattcataatgtattatttcaactatttgattgataaaactaattacatcttcagtttgagcaggattaagtttttctttttcaagataaaatgaggggtagtcactttggtggactatttggttacgcctctgagcaataagattcaacttcttagtaaggaaattcttttccacccccatttgaattgaaatagtctgccacttatgcgattctgtccaaattaatgataacccttcattaatcttttctgcagtttgatacgaattaaaagccaattttttaactataaattgttcaaatgcatgtgaaataaaagatgagtcatcaataattgaaacaggtataggaaaactattaaaacttttggtaggggttatctctttattaaatgttttaatgagaccaattcttattatgtcatgtatatatttatctaaggctgagacagcctgagtccactgccatcttagtaaatcatctaatggaattttaaagtgctcataaacagttgtcatttgctgtgtttctttgattattattttaaactgattgattgccaaattcattttattgttttaacaattgcgtttgttaatttttcaaaaatgaaatttatctctctttgtttctctaacatctgagctttaactggtccggttgttcccatttgttcttcactcaatgaaaaaattggcacaccatgttcatgagatctttggtttaaagcgccaaattcgggtatttgagctaaacaatacgaatcgacataattagctgctttagattctgtaatatcgtataccatatcaacagattttaaagtagataggaagtcattctcaataaagttctgaatttcagtaatcttatctttataagcagctgccggttttttattgcgtaaattgaatctttgaataatctcaccagcaaacttagggcttctttgtgggagtggatatgttgcactggaaaaaacgggagcaaagttattagcccattgtttccatcttggtagtatcttgctcattgtttttaaggccattatagagaatggatctgggtttgttggaattataaatgcgtcagaagaaataaaaaatgtttggtttatagcacttaatccaggattcatatctattaatacatagtcaattgaatatttgtcgacacaaagttgtattagttcataaaaagaacctggtaggttttggagagtagtaattgcattattactattcagagctaagctaagagctggatcatattctgacaaatccatgtggccaggtatcaagaagagattatgattttctgatggtgaataacactcaataggtttaattggttgaggtgccccttcaaatgcaggacgaacagcatcttttatattattatagctattctctcccacataataatcttcaaaatcctcttttaatagtaaacctgttaagttgcattgtggatctccatctactaataaaactttatatcctttgtctgctagtttccaaccaatattataagttgtggtagttttgcttacaccacctttatgattaaaaacagaaatgattttaaattcatctgatttgctagtcaaaaaattcaatcctttctagatgatagatacattatatcatatcatatccataatcatgaagaaatggatagattaaattctaataactgtatttttaggttgtaagtaaacttaaaaatttaaagggtcaatgacttgtcgtcaatattcaattttactgcgaattctcctgttaacttatagtgaataaaacacaaaaaaaccagattccgatacaaatctggtttcccacagctgattagaagcaacctactgttgcttctctttcaccatctttataaagagaaagaagacaatgaatacaataaagtaattcaatggattcttaacgatgtttatctccagggaaatctgtaagagtatccagagaatgaagatggctagtattgaaggaatgatgattttgtacatgtcgaccaccttccatagttagtaaaagaaaggggcgcgggcccctttttcttcatggttaaaagcaagatgcggcagctcctgtcattgcgccgccaacagcgccggtaattgctccgacggcacccgctcctactgttccgataccgggtattgtgactgttcctacagcagctcctgcaagacccagtgtgccgcctccagttaccgcaccaccgccagtacctaaaatacatttcccgactgattgggtgctgattgacccgctcgtttttccagcgtctttgtttacgactttgactaaaacgccatttttgattttttcatattcagtgtaacggggtcaccatttttgtcagcagagcttttcggaagagcctgctcctcgcccgttatgttgtcttttagggttgcattgcctttagcgtcaatatgaacatctgcatgattgaacgtcatcttcagctcactgtcgttgaggttttcaactttgtatgtagcttgggattctgcagcagccgcagcatgaggtaaaaccgggagggcaaaggcacctgctaggaataccaaggctgccagtttcactgcggttagcttcattctgctttgcataattgatcctcctcctttggttgccatactaacaaaggcaatctgcatcttaaacccttaccatataaaatgataaaaaattcacccaatttcatcacattaaccaacacggtttgtatgtttcccttcgaaaggcatagggggacaggcttcatatctggggcgaagctatcaagaaaggtgaagcacctgcaaagagtagtaaataatgtatcatttgctaacgttctcccatcttccgctttttccatacgacagtataaatccctttgcgtcacggaaacctagtggaaaaggtttctgaaaggagggggtgtatggtgaaaagtgaaaaaattcaaaacaaaacatctttggtttggaagatggcgattgcatctgctgtttcttgggaagcggcaaaactggcgggctctgatcatccctatttagcgcctctatctgttatcttatgtttgcagccaacgatagatcagtcgattcgcttttcttttcatcgtattgcgggaactgcgattgggatcatgctaacgtcctatcttgtcagtcacttgccaatgaatggctggatgctggggctgttcctattaggcggtacttacattgcgaagtggttacgaatagatgtaacggttttacatcaggcagcgctcaccattttgttggtctttacgtttgaacggaactctaaagattatgcattcgaccgaatcatcgatacggtgatcggcgtcatcatcgccattctggttcacatgttcctttttccgccggactacacaaaaaaggcagcggactcttttcaaacattggctcgtcagctttccggcacactttcagacctctccaaatgggtgcaatcagagtggggacaaggaaaagggaaccttatggaatataaaatgaaccatcttctgcgggagctgcatacggcaaaagagatgctgcaaacagcctctgacagcttaaaattcaaccccgtcagaaaaaaacataaaatcatcatttcaagctatcaaatagagatgcaaaagttgaacgccggatttgagtatctatcaaatatagtgaaaacgttaaaagaatgggaaaaagaaggagctttatcttcaagtgacaaaagggagctggggaatgatttacaagtgttaagtgaatactttgcgggttttaaaggcatacagcatggtgaaacagacaattggaaacagaaggaacaggtcatgttattggaatctctccgttccgacatgctgtcgcacccgccgcccggtcataaggtctataaagactctttttttttagaaacgaagaaattgctgaagcgtttgtaatgttttccggaaaaaaagaatacggatatacagatgcagatatgatcaggtaaaagcgggggacatgaaatggatgatatacaccggattttggatgtcatcgccacttctaaaaaagctaaggtactggctaccatcattaaaacagaggggtccgcttataagaaggaaggggcctccatgctgattttaggggacaaaacaagagtcggaatgttatccgccggttgtctggaagaagatctcgttgaacggtcggaacaggtctggactgcgggagagccgttgattgtccgctttgatatgagcgcggaggacgattaatcctggggacagggcattggctgtaatggtgttttgacggttttgcttgagcctgtaaaaggggaattggaacgaaatctgatgacagtcaagacatgcttagatgaaaaaaagtctgtgacccgagtgaaacgattcactgaaacgttagagccgaaggaagatctgtatatagctgaagacggcagcgtgtttggaaccggggatgttatggaacaaagccgtattcaaaaactgagacagacagagaagggaatcaaaagggatgaacatacatctgatttattttttatccatcagatggttccaaagccttgtctatatgtcttcggagcaggggaagatgcgaggccgttagtttcgttggcggctcgtgcgggctttcatgtgacggtgattgactggcgtcccgccttatgtcatcacgggcattttcctgaagccggccatttgataacgggagcgccggaagaagtcatggaaggcctgagcatgacaaaaagggattttgttgtcattatgacgcacagctttcaaaaagatcagatcattttacatacaataaaaaacgagaatgtgttttataaaggcgttttaggccccagaaggcgcacggagcggctgttaggcggggcggagattccggcagatattcattcccctatcggccttcccatcggggcacaaggccctaaagagattgctgtaagtattgtcggcgagatgattaaagaaatgcgaaaacaaaggtctcgcttatgaaaacagcagccatttacctggcagccggtacaagcagacgcatggggacggataagcgaagtttagttctcaatggcgtctccctcggaagtatggcgcttaaacatgctttgttatctgaattagatcatattttcgttattacgggaaagggagattcactgcattggctttcggaatttttctttttatcccctatgtcaaataagtggagccaggcagaatgtgagcaagcgggtaagggccaaggccattctatactatgcggtttacaaaaagcggcagcgtacgaggctgacgccgttatcattctccttgcagatcagccgtttgtcaccgcagatatcatcaatacgttaattgattcctatcacaaggagcgccgttattcatttatcgccgctgaaaatcaacatcttcctatgccccccattttattctccaatcaatgttttccggtattgcatcagttaaagggagaccagggcgcccggcatgtgatccgtgaaagtatgatcaatacgggaaaaatgatcagctttcaagaccctttgcttttttatgacgtcgatacagctgaagattatacgctgctgctgaataaattcggggagtgaatgagttggagtatatcgggaagagtgtcattcggaaagaggcccttgaaaaagtgacgggtaaagcgaaatatacggatgattttcaagaaacagggacgttacacgcaaaaatgctgaccagtccatatgcgcatgccgatattgtgtctatggacttttcagaagcttggaagattcccggcgtgagagcgatattgggggatgaaccttttccgcttgcaggtgaagaaattaaagacagatcgccgattgcttataaaagggtcagataccatggtgagccggttgctgttgttgttgcggaaaatccgattacagctaaaaaggccgcggatgccatcaaagtatcctataaacctcttcccgtcgtcaattccccccgtgaggcctttcaaaaggatgcgccgctcgttcatgaacatgcggaccgctatgagaagacaaaaggtgtattcccggttccgaagacaaatatcgcaaacgtggataaggttagaaaaggaaatattgaagacggatttagggaaagtgatgtgacagcagaattccagatttcctttaacccttctgatcacgctgcgatggagacaagatgctcgatcgctgaaattcgggcggatgaggagattatcattaccacatcctctcaagctccttttgccattaaaaaattaatgcagtggtattttggaattgaacccggaaaggttatcgtcaaaacgcctttagtaggcggggcgtacgggggaaaagcagccgttcagttagaggtgattgcctatttggcatcaaaagcagtcggaggccggcccgtcaaattgtttaatacgagagaagaggatatgatcacatctcccgttcatgtaggattggatgccattgtcaaattaggggccacaaagaatggaattttaaaggcggcggacattcagcttttatttgatggcggagcatactctgataaaggagtggacatcagccgggctgcggtggttgattgtacgggtccgtacgctatcgaccatatatcgtgtgattcatattgtatgtatacgaatcacccatatccaagtgcattcaggggctacagccatgctgaagtgttatttgcttttgagcggacgatggatgtattggcggaaaagctgaacatggacccgttagaactccgctataaaaatgccattagccccggtgacaccacaccgactcaagttcttctcaattcaagcacggtcggaaatgtaccgaaatgtattgaaagattgaaggaattaatgaattgggacgagggacagcgaattgaaatcgacggccggaagatacgggcgaagggaatcagctgcatttggaaaacctcaacatttgatacaaatgcaacgtccggagtgattttaacctttaatcctgatggaagcattaatttgatgtcagggatagtggagattggaacagggacaaaaacagtgctagcccaaatcttagcagaacgaatgaaaatggatataagcaaaattcacgtaaaaatgcttgtagatacacaaacaacacccgagcattggaaaaccgtggggagcagagggacgttaatggccggaaaagccgtactgaatgcagcggaagaagccattcgaaagctgaaggacgcggcatcatgtgtgttgcgggttcctgtcgaggaattggaagtggccgacggaaaggtttattttatagatcatccttctgtacatgttgacataaaagacattgcttacggatatacgtttccgaatggaaataccattggcggccaaatcattgcgagcggcaattacacattaacccggatgacgaatttagaccgggaaacgggaagaggaaagccgggacccgagtgggctgtcggtgctcagggaattgaagttgagttggataaacgggattatacgtatcggattacaaaagcctattctgttgtggatataggaacagtattgaatgaaaaagctgcaaggggtcaagtgatgggggggatgagtatgggaatcgcattcggaggaagagaaacctttgtctttgattcatatggcagagtattaaatcctcagcttagaacataccgcccccttcactatggagagcagcctgaatatatcattgaatttgttgaaaccccgcatgtgattgcgccttatggagcgcgcggcggcggggaacacggactgctggggatgccggccgcattgggaaattgcctttccgccgctttaggtgtccaattgaatcaacttcctctcattcccgaacgattatggagaacgcaagaggggtggaaagatgataccgtttgatttcgactattttaaaccgaagaccattcaagaaacaatcaatctatttcactcgcttgcggccgaaaagaaaacaccaatgtattattccggcggcacggaaattatcacgttaggaaggctgaatatcgtctatacggatgcggtgatagatatgaacgcgcttccggaatttcacgccatccgtttttatgaacgttatctggtgatcggagcaggcgtgtcattaacgaaactggaggaagaaaatccatttccgctattaagtaaaacggtaagtgaaatagccgatcggacgactcgaaataaggtcagcctgggtggaaacatttgcgggggcatctactaccgtgaggccgtgctgccgttgctgatttctgatagtttgatagggattgcagggagagcggggattcattaccgtcccataaataaagtatttaacaaggaaatacagttgcaaaaaggtgattttttatttcatgtcgttgtcgatcgagcgtacgttgacctgccatttgtcagtatcaaaagaagacagcagtggaatgtcgggtatccattggtgacagtctgtgcgctgaaaaaagatgatgagatcagaatggccttcagcggcgtatgtccatttccgtttcgttctgctgaaatggaggctgtgcttaacgataaaagccgatcagcagaagaaagagtaagcaggtctttacagtatgtacccaaacccgttcttgatgacgcagaaggctcaagtgaataccgaatgtttgtcttgcaaaatacaattttagatgccttacgggaattagaaggaggtccaaatgtctgatcctattacgttgaaagtaaatggcgaggaaagacagatgacggtcaggccggctgatactttgttatttgctcttcgtcttcgtctcggattaactggtgcaaagccgggctgcttaaatggggattgcggcgcctgtacggtattaacggacggggtgccgatgaaatcttgcttaatgcttgcggcagaaggggaaggaaaggacattacgacgattgaaggactgatcaatacgccgattcaaaaggcctttattgaaaaattcgcgtttcaatgcggttattgcacaccgggttttctcatgaattgtcatgctttagtgaatactgagccgaatgcaagtgatgacacgataaaaaattggctggagtccaatatttgcagatgtacgggttatagggagattgaagaagcggttaaatcggttttacatacagggaaaccgtaaaaaaagagcccagagaatcatccctgaactccatattcttcacttcatataccgatactcccgcagcttctccaaaatcgccacttctttcatcagttcttcaccgacgtttgtttctttcactttcttacgctccagctctttgtcgactaatcgtttcactgttaagacgtcggttccggtgctcagcacttcggccttggagttaaagtgtttatgggcgacgagctgcatgccgtaggagttgtataagagcgtgtagccggcgatgcctgttgtggattggtaggctttggagaagccgccgtcgatgacgatcatttttccgtttgccttgatcggatcttcgccttcgatttcttttaccggtgtatggccgttgatgatatggccgtgatccgggttgaggccgaattccttcaggatgtttcggcaggctgcttcgtcttcgcgcaaatagtaatacgggtttttcttttctttatgcgtttccttctctttaatgaaataccgctcaaaggttgtcatggcgcgttttccaaagagggaggagtattcgcctgtccataagtaccacgtcatatctgtcgccagatcatcggtttcttccggatgggcaaacgcttcccgtaagaaccgttcaaaaacatctagcagctcacggcccgcataagctttatcctctatcatcatcgtttccatgctgccgttttcatcgacgggaatacagccgtgaatcagcaggttgccgttatattttaaataaaggctgccttttttcatcataaaattcatatggcggcccagtttttcggagttctgaacagagaacagcagcttgtccatgacttctgcttcttcctctaacagctcgtcaggctgtttgggattcaccgtcgcaaagcaggtgttttccagttgatatgtttttccgttcagcgtgatttcattgcggtcataatcgatcttttccagtaacagccgttcctccatattaaagttcggccgtctcttaataatcgggctctcaagcttaaattggatcatcgcaatcgcctgatgaatttttgtgatttgtttaatctcatcttccggtctgttttcgtccgctttcgggcggaaagacgggttatcatcgtaatatttttcagcaaggttcaatagcggtctcagattgatgccgtaaacgtcttcaataatatccagattgtcatagcgggcacagatgcggataatgtttgccaggcatacttttgagccggaataagcgcctatccagagaacatcatgattcccccattgaatatccactgaatgatagttgatcagttcttccatgatcttatccggctgcggtccgcggtcgtaaatatcgccgacaacatgcagatggtcgaccaccaaacgctgcgtgctgtaggcaaggccggtgatcagcttatcggcctggccgagcgcaatgatctgttctatgatttcggagtagtattgttccttgttggcggcttgttctgttttgtacagcagctcttcagaaatataagcaaattgggcgggcagcgctttgcgcaatttggagcgggtgtacttggaagaacaataagaaacgagcttaatcatccggtgaatcgtttctttataccactcgtttaatgcctctttcgtatcaaagtcatgtttgatcagctgcagtttgtcctcaggataatagaccaaagccgtcagttcatcaatttctctatcgtaaatgacgccgctgaaaatatcgcggatcttctcttttacccttcctgaaccgttccgcagcacgtgctggaatgcctgatactccccgtgcagatcactgacgaaatgctcggttcctttcggcaggttcagtatcgctttcagattaatgatttccgtgaccactttttcttcacaatcgtatttttgtgcgagcagatctaaatatttcgtttccaatctcgtccatcccctttttatttacgagcaattgtatgataaagtgaatttaaagtatgacataatgtttaaatgattagaccttatatgatagtaccgcataacgcctttttgagacaatgaaaacggaaaatacggcgcttcaggcatcaaaaattggaccgggataacgccgtgcagctcatccctctattgacaatgcattcaagttccattaaaataaaaagttagctgataggtatttctatcagaaactcaatacgtagcaggctatgattgctgtgggtcgaactacagcaggagcggcttctggagagaccgcgggttttccgcggcgccgaagggttcacaatctcaggcaaaaggacagaagagtaccgaatatgtatttgtcatgctgttgattgtcagcggcgcagatataatttgatattcttatgaccatgagattggagggcatccaatctctttttttattggctttttttgctcgtcgttcactagagaggtaaggaggagtcagatgtggagcagcgagagctaaagagggacttatcgaatcggcacgtgcagctgatcgccattggcggcacgatcggcaccggattgtttttagggtccggtaaggcgattcagctggcgggtccttctatcatctttgcgtattttattgtaggtattgcgctttttttcgtcatgcgggcgctgggagaactgctgttatctaaagcgggctaccaatcattaacggatattgccgaggcgtatttagggccgcgtgcagcgtttgtcaccggctggacctactggttttgctggattatgacggctatggcggatgtgatcgccgtcggtgtgtatgtgaaatattggtttgatattccgcagtggattccggcacttatctgtttgctcattttattagggcttaatctgttaacggttaagatttttggagaattggagttttggttcgccttaattaaggtagtcacgattctcgcgttaattgtcatcggggtggttctgctggtgattgggttcaaaacgcataccggaacggtttcagcggcgaatctgtgggagcacggcggcttgtttccgaacggattttcaggctttttgctttcgttccagatggtgatcttcgcctatgtcggtgtggaattagtgggtgtgtcggcggcggaaacgtcaaatccgaaaaaaaatattccgtccgctatcaataaaattccattgcggattttatttttctacgtcggggcattgctcattcttttatgtattaatccgtggatgcagctgaatgcggcggaaagtccttttgtaaagaccttcagcctggtcggcatcccgttagccgcgggaatcattaattttgtcgtattaacgtctgccgcttctgcttgtaacagcgggatgttttcaacaagccggattttgtataacttaagcaaaacgaaacaagcgcctgcaagttttgcgaagctgaataaaaatcatgtgccgagccgcgcattatggatatcggttattgtgctgtcagctggcgctcttttaagcaaattgataccggaagcggcttttggcatcgtgaccaccatcagcgcgatttgtttcatttgggtgtggggcgtgattcttgtctgtcatatcagatacaggaaaacccgtccggacttacatgcaagctcgtctttcaaggcgccgtttgcgccgtttatcaattacgccgtgctggcgctgtttgccgtcattctggtgattatgctgtttgcggatgtaacgcgcccggctttgctgctgacgccgctgtggtttattggattatttcttatctatcgggcgagagggagaaagacagattgaattgcttcagacggtgtactgccatgcagtatgccgttttttgttttgattggaaagcgagaatatttgttagaaatcaggctataatgattgtataatttaaaaaagtgtataattttaaattaagcgaggtgatgatatgaagtatgagaagttatctaagcttttttataaaatggatgctgattcatatgagaaagaatttaaaaagagaacaagcagctatggcagttattcaacatcattaaacatacgggggttccgaaaaggccgacccacgggcgattcatttgagctattttatgtgaatacacataaactcatgaagctgaataatgaagtgttgttaaacagttccaaaatttcatcccttatcagtcagctccccgaatttgccgtcaaaccttattttgataaattaattattaatgaagcacagagtaataatgaaattgaaggaatccgcagtacaaaaaaagaattgaaagaggctcttaaagcgttagaacaatccgagccctcacataagcggtttgtcggattgatgaaaacatatcaatttatagaccgaattccgtcgtttacaagcattcatgactttagggaattatatgacgagctggtcgcagatgaaatcggagcagaagatgcgccggatggtgagctattcagaaaaggctatgttgaagtgaacgatgggaacatgaccacccatatcggcgttaattctgaacagaagataacagaagcgcttgaggctttaattgcttatcttcatgatgaaacacatccccagctgtatcgttacatgacagctcattactactatgaatacattcatcctttttatgacggcaatggaagaacaggacgccttatcgttgggagttatttgtcccgatacttagaaaaatattcagccatcactttttcttacgcagttaataagaacaaagataagtattataaggcattagaggaaattcccgcacctttaaaccggggagagctgactttttatttaatggatatgctggaattgcttctgtcaggacaaaaagggattattgaggatcttgaatttaatttaatgaaactgaaacgaattaggaactatattgatagtgatcaatgggctgattataaggatgaacgtgatatttttaatatcattatcacgattaatgtatttgtaaatgatcaggttacgctgtcggtgcaagatttaatggagctctcaaataaatcgagacataaaattaacagagtaatggattatttagaacagcaaggatttgttgagctggtaagcagaaggccaaaatcttataaaatcagggaggattgtttagaggagatactgccttcttaattagtatatttaaaaaagccgccatatgaatggcggctttcacattaattccggatcaaataatcaaatgcgcctaaagcggcagttgcacctgatcccatggagataatgatttggttgtacgggccgtctgtgcagtcccctgcggcaaataggccgggaacgcttgtcgcgccgctcttatcgacgatgatttcgccgatgcggttgcgttcgaccgtttcgtctaaccattctgtattaggcacgaggccgatttggacgaatacaccttggagttcaacgtgtttttcttcgcctgtttcacggtcaacgaacgtaatgccgtttacgttttggtcgcctgtgatttctttcgtttgtgcatttttgtgcacagtgacgtttggcaggctgtaaagacgtttttgcaggacttcgtctgctttcagttcaggcgcgaattccagcacagtcacgtgattgacgatacctgcaaggtcaatcgccgcttcgattccggagtttccgccgccgataaccgctacgtctttgccttcaaacaatggtccgtcacagtgcgggcagtaagcgacacctttgtttttgaactcttgctcaccaggtacgttgacattgcgccagcgggcacctgttgaaaggatcactgttttacttttcagtacagcgccgttttcaagttcaagttcgaagaggtcttttttctcaaggcgtttcgcgcgctgaaggttcatgacgtcaatatcataatctttcacgtgctcttcaaggcttgcagcgagcttcggtccttcagtcgctttgacgctgatgaagttttcgatgctcatggtgtcgagtacctggccgccgaagcgttcagcgacgacaccggtgcggatgcctttacgcgccgtgtagatcgccgcgcttgcgccggcaggtccgccgccgacaacaagaacgtcaaacggctctttgtcggcaaactcagacgcatctgcgccgctgcccattttcgcgagaatctcttcgatggtcatacggccgcttccgaaagattcaccgtttaagaaaacagtcggaacagccataatgtttttgctttctacttcttctttgaatgccgcgccgtcaatcattgtatgtgtgatattcgggttgagcacgctcatcatgtttaatgcttggacgacatcagggcagttgtggcacgtcaggctgatataagactcaaagcggtattctccgctgatgttcttaatctggtcaatgaccttttgatcagccttaggggctctgccgctgacttgaagcaatgccagcactaaagatgtaaattcgtggccgagaggaacaccggcgaatgtaacgcctgtgtcttctccggtacgattaacgctgaagctcggtgttctgtttaattcagttttttcaactgaaattttagatgacatggaagccagctcgtcaacgagagccagcatgtccttagaagtgtcatcgtcaccggcgcttactttgagaacaatgtcgttctcaattagctgcatgtattgatttaattgtgctttgatatttgcatcaagtaccaatggaatgcactccttagattttacctaccaaatcaaggctaggtgtaagtgtttcgccgccttcttcccatttagccgggcagacttcacctgggttttgacgaacgtattgagctgcttttactttgtttacaaggttgcttgcgtcacggccgataccgcctgcattgatttcaactgtttggatcacgccatcaggatcgatgatgaatgttccgcggtcagcaagaccagtttcttcgtcaagaacgtcgaagttgcgggagatcgtttgagatgggtcaccgatcattgcgtaagtgattttgccgattttttcagagctgtcatgccagcctttgtgtacgaagtgagtatctgtagaaacagagtatacttcaacacctaattctttcagtgcagcgtattgtccttgaagatcttcaagttcagtcgggcaaacgaaagagaaatccgctgggtagaagcagaaaacgctccattgacctttcaaatcttcgtttgttacatcgatgaattcaccgtttttaaaagcttttgcttcgaatggcagtacttcttttccgattaaagacataatatcttcctcctgaaatgtgatttgaaatatattaaaaagacaaagcattcactttatctttcaataataattctaattatatatagattattaaataacatttattttttgtcaagctatatggggtattattttctgctttttttgcttcagacgttaaaaaacgcctggtataagcggtttggcgctgtttgtcatgtttagcgccgggcgaaagggggattctcaattggtgaatcgaaacagtaggaatcaacccctctatatggcagtataaaccaaagggggtatgatcatgcaaataaataacattactttgtacagttgtgcgttggaggagacgaaacacttctatgaacgggtgttaggttttcctttaattgatgagtccggtgattcgtttaccatcaaggcgggagaaagtgagttggaattcaggcgcgccgattctcactctcaaccgacgtatcattttgcgtttaacattccgaataatcgttttgatgaggcgaaggcgtggataaaggataaagtcgtttttcaaacggaagatggggaggatgaggtgtatttctcccatattcaggcgcgttccttttattttaaagatccgtccaacaatctggcggaattcatcgcgagagacacatcgccggcaagcgcggaacgtttttcgattgagtccgtcctgaatatcggcgaggtgaatctgacggctgccgaggtggtatcgaccgggaaggagctgcagcgtttcggcattccggtgagaaagcatgcgcctcttagtgaaaacgggtttcattttatgggtgattacaatgatggggcgtttttgcttttagggccgaacgggcgccgctggattttttctgatcagcatgcggagtttcatccgctgtctgtcgttgtgaacgggacgatccgcattgaggctgacggaaagggcggcattgacatcaggcgggcacagccgtcataaaaaagcccgggctcaaaaggcccggacttgaggtcattatttatagacaacacgggtgctgcacatgatgtcgtgcagcgtttttttctctccgaaggcgcccatgatgaatccgatataaagaatgagcttagatatgatatatgcgaaagcgcgtccgaaggcctggccgatggaaatgcgtccgccatcttcattgacgaccttaaggcctagcaatgcttttcccagtgtcccctgcatctttgaggccgtgagcaggctgaaatataagatactgatcacaaaagagctcgcaagaatcgggatgacgccgaacaccagaaaagagatgttaaactgattttcggtcatgaaggggtcagccgccgcaacgcctgccgcaaataaaaaagagaccataaattgaatgataaaaatcggaattcctatgatgatttgatcaatgacgtaagccagaaaccgaatccaaaatcctgccggtctttccatgtatcattttctctcccttgctttaatctggaatattatacgtaatcattccggattttgcaacggagcttaagcttctgcgagcagcctctttccccatgccaagcgtcccatgatcagcccgaaagccagaagggcaaacatgatgccgcaacacatcagctgatggattcccaaatgggaaataaaccagccgcccgccgccgttccgatggtgatgccgaggttggaaaaagagacaaacaggctgttgccgaattcgggggcctcctttgcttccgcagtaagccatgtctggctgacaatgagcccgccggaatgaacggcgccccatacgaagacgaggacggccatcggcgcgaaagacgtcccaaacccgtatatgagcaagtaggcggctgtataaagaagcggaaacaggatgacggtctttttcatatttttatataacaaagcgccgaagacgaaattcccggctatcataatcactccgaagctcatcagcatgaagctgacccatgtgccgttcatatgggacacccgtccgaggtactccgcaaaatagctgtagacagaaaacatggccgcaaagagacaggtgacggcagcgatattaagccacaagaccggcttgcgaaggatgccgagctggcttctgaaagacatgttttctgtgaccggcatggatggcaaaaagagaagaatacctgtgaatgcgatgagactgatgatagcgccgaataggaatgctgattcaagggagagacgatccgccagataagacgtgaaaggcacgccgaacgcaaagccggcggtgatgcctgaaaagactttcgttacggcttttccggattggccggcggggacaagccgggccgcggccgcaagcgctacagaaaagaacaccgggtggcataaagccggaatgatccgaaacgccagcatgacactgaaatgcgccgtatacgcgtagaccgcatttgaaacggcaaacatcagcaccgccaaaagcagaatgactttccggtttatacctgaagcaagcaaggttaaaaacggtcccgacacagcgacgatgaacgcgaaaatactgacaagccaccccgcttttgaagcagaaatatgaaatctgtccgccacttgcggaagaacgccgataatgcccatttcagtcgtgataattccgaaaacccctaatgccaaaaacagaatgaagatggagctgctttttttcattgttatgtatgcctccttttataactacatatacagaaaaatagatatgttagaacaaaaaaaacctcctttcatggttatagctggtgctgaacatagtcagcaaaggctttaatttgtttttcattccttctgtaataggtccattttccgattcgttcggattccagcaggccggctttttgcatggtcagcaggtagctggagatgacggactgcgcaagccccgactttgcctgaatatcaccgacgcaaattccggtgcggaagctgagtccctgatcaaggtaaggtttttcatcaaaatggtcctccgggtgtttaagccacgtcataatatcacttcgtgttttgttagatagcgctttatgaatcaatatcggttccataacatttattatatctatttttctggatttgtaaattcgtttttgacaaaacattctcaaattaagtaaaaatcgtgctaaaatataacatattatcagattaccggtaaaaaagccgggttattgtcaggaggatattcacatgaatcaaaagaaaaaaggtacggttgcggtgaccttgctttccgctctgctgttttgtttattgccggtcctcgtctcgctttctccgcttgcggaaacggggccgaacgcgaatcgttttaattccgcgggcatgtgggccgccgtcggccagatccttgttatatatgcggtcccgctcattatgtatattctcggtattcgtgtcatgaaaatcatcatggccgttttttgcggaatcgggcttatcatttgcgcggctgtcttgttggtgacgttattgaccgcaatttccttagggcaggagctgtctctttattacggccttttcgtttggtcaggcgcggctttcatcgtcaatgtggtgtggtatattgccgcgtttcgatcatccccgaagcatcagcaggctatgtgacatttgttctataaatctaccgaaaatacaaatatttcataggatgattatggtatgatgaaagcggtatagcagtttttaatagaaacgggaggaactgacattgaaaaaaaagacagcttcattgcgaatgaaaacattggcggccggcgctgcggttgctgcggctttatctgtgggggcggtttctgatctgccgggggcaaaatggctgcatccggccgctgctcaagctgcggaaacggtatttaaacaaaatcatgcggcatccggtttcttggcgggacggtatgacgcgcaggcgatgtctccgacgatgttcaactggtcaagagaaagccggtttacaagcactgccgatggcgcgttaaaatgggaaaagaatgttccggccaatcctcaaaacggcgcgggagccgcggttgacggggacggcaccgtatttattcaatcaaaagacgggaagctgacggcgtatcatccggacgtactgtgaaatgggtgacggaaaacctcgggacgacctatacgctgactccggtgctcggaacaaacggtgttatttatcttccttctcacgataaaaaactgtatttcatcgacaaagaaaccggaaacattttaacatcggttccgttgagcggagcgcctagttccgatgcggctatcggctctgacggcacgctgtatgtgtcgacgctggataactatatctatgcgattaaaccgacgtcgccttcgacatggacgcagaagtggaagtttaaaacaaacggcgtggtcggttccgctcccgtgttagcatcaaacggcactctgtatacggcaacgtacaataatatcttttacgcgatcaattccggaactggccaagtgaaatggtcaaaaacgacgtccaacgggtttaaaggttatccggttatagatagagacggcaccgtttacgccggaaaccaggacggcaacttatatgcctatacatcaacgggtgctgtaaagtggacgttcccgttaaacggtttctccagctcttcattagcgatcgaccataacggcaatgtgtatatcggttccggaagcggcgagctgttttccatcagcaaaaccggcaatatgaactggtctttctatacggacgggcctgtaagaacggcgccgctgattgatgcggacggcaatgtgtacttcggctctgacgataaaaacgtctatgcggttgacgctgacggtaatgaaaaatggcgctatcaaacagacagcaatgtcatttcctccccggttctggctgaagacggcacgctctacgttggcacttatacgaaactgctcgcattcggtgcaaaaaaataataaaaaagaatccgcgtgcgcggattctttttttatttagaggcttgaataaatacgcctttttcatgagagaattctttaaagccgtacacaccgtgatatgaaccgatcccgctcgtattgacaccgccgaacggaaggttgacgtcagtgaaatgaacgacgacatcattgacagaagcattgccggacgtcgtatgctgcagaacataatcgatcagctcctgattatggctgaatacatacaaggcaagcggcttgtcccgttcagtgatgtaatcaacggcttcactgatatcttcgtaattcataatcggcagaatcggtgcgaagatttcttcctgcatgatcttcatatcaggcgtgacgtttgtcagcacggtcggagaaatcgtgcggtcatgcgcatcaaatacaccgccgaacgccgttttcgcccctttttcaatggcatcatcatacagagctttgacacggttaaagttgcggtcgttgacaatctgcgtgaatttgttgcggtcaaccgtatgatcatcctccataaaacctgcattgacaatggtctggagaagatctgtaaaggtgtcctgtacatcttccttcataagaagatagtcaggagcgatacatgtttgccccgcattgacaaatttgccgacggcgatttttttcgccgcgtccatcaaatcatagccgctgtcgatgatcgtcgggctttttccgccaagctcaagcgtgacggacgacaagtgcttcgccgctgccgtcatgacgattttaccgacattcgtgcttccggtgaagaaaatgtggtcaaacggctggtcgagcagttctgtggcgacatcgacctcaccttcaaaaatggcgacttcttcttcgtgaaatgcctcgcgaataactgtcgcggcgatatggctcgtctccatcgtaaaatcggacagcttcacaatcgcgctgttgccggccgcaatggcagccgcaagcggagccatcgtcagcataaacggataattccatgggccgagaattaaggtgacgccttttggctcgtacattaatacgccgtcagcgtcggggctgacggatgagccgacgcgtttcggcgccatccaggtgtcgagattgttcatattatctttaatcgccttgatcgttccctgcgtttccgctcttttcacctcatgataaggcttgcggacgtcccgtctgatcgcctcgatgatttcttcttcatgtgcggtgacggcatctaaaaagcgctgaagcttttctctgcgctgcccggctgttgaagcacgcagcgttttttgattttttttctgaagctcaaagacgcgtttgatgtctgcttttatatgctgatccatcggtcttcctcctctggttgcttttttgtttcttcagggcctattataatgtgatgtgtttttgcggcaaagacagcgtaaacacatctatacgttaccgtacaaattgcggtgatctgtctaatgaaaggagtgtctcttatgccggattctgtgacaactgacatcaaacaagcgcttttggccatgcttggagagcgggatatccgccgtgtgaccatgaaggacatcgccgaacgggcgcatgtgagccgggggacactgtacctttattacgaagataaatatgcgattttagaggatatagaggaagaaatgaaagacgggctgagcgaagcgctttatgattcgctgaagaataaagatgtgcttcatttacatggcggatggcaaaaagtgcatccgaccctgtcttttgttgaccggcatcgggagttttttcaaacgatgatggaccgtcataaaatgccgtattttcactttcatgcttttttaaaagatgtgttccggcatgatgtgctgctgtcaccggtcaatgcggatttctcaccgactgaacaggatatgtacattcattaccgcgcgttatacacatatgccattgtgttgtactggctgaatgaggagcccggagcatccccggaagcgatcagcggacaggtgtgggatttaatttctcaaaaacggttttactggctgttcggccgccgggtgccggaacaagaagaaaaaaagcccgccgaccgcagggtgacccggacgaggcaggccttgcaagaagccatgatcggcttaatggcggaaaaaaaagagtacgcggcaatcacgatttccgatattgcccgtcaaagcaacctccgccgtgccactttttatgaccattacgccaacaaagaagcattgctgaaaacgatcatccatcaatcatgccgggatctgatcggattattgacggtaaaaggagagcctgccgattgctccatggaagaagcggaagccgcgctcgtccgtctcttttcggcactgtcggacggcctgccgctcgtccattttctgagagagggttcgggagtgcctgacgtcatcccggaaatgttcagagcgctgcaatcgttttatcttcatcagcctctgcacattcaggcgggcaaaaagctctatgcatactatgtcgcatccatgctcgtcggtctgattcaatatcgccttcatgaaggaaaagaccacgcgccggacaagctggcccgggagtttctgcagtttttggatgtgaagaagtatcgggtgattttgctgtgaagatgatgaaaaagaactcccaaaacaggcggagttcttttttgctgttttcttcgagaagtgccgatatgaattgtccggctaaaaagaaaacctgccatatgacgccagatcagcatttctgctgccaaacatgacaaatgtcatattcggggcatgatggctgctactacaaaagcgtccggcgccccgttatacttgggatcataatgaaaaagaagggacgtgacatccatgatcaatcacgccgcaactcaaaaacaagcgtctttaaaaaagcaggttgccgcattttccggtgccgatacaaagcatagtgtcattcagcttctcaacacgtttgtaccgttctttgccctttggtttcttgcttacttcagcctcgatgtctcctattttctgaccctcgcctttactgtaatagcagcgggatttttgacaagaatctttattattttccacgactgctgccatcaatcctttttcaaacaaaagaagctgaaccggctgtttgggtttatttcaggtgtgctgacactgtttccgttctctcaatggcagcgcagccactccattcatcatgcgacaagcagcaacttagataaacggggaacaggcgatatttggatgatgaccgtcaaggaatacaacgaagcgtcagcctggacaaaagtacgctacagactttatcgcaatccgtttattatgtttattctcggcccgatttacgtatttctgattaaaaaccgtttcaatgtaaaaggcgcccgccgcaaggaacgctggaacacctatttcacgaacgcggcgattgtcttattggctgctgcgacgtgcctgcttgtcggctgggaaaactttttgcttgttcagggtccgattttccttatttcggggtcaatcggcgtttggctcttttatgtccagcatacattcgaggattcttattttgaagccgatgagcattgggactatgtgcaggccgcggtagaaggaagctccttttacaagcttccgaagcttttgcaatggctgacgggcaatatcggctaccatcatgtccaccacttaagcccgaaagtgccgaattacaagctggaagccgctcacgaggggcatgaacctttaaaaaacgtaccgaccattacgcttaaaacaagtcttgaatccatgaaattccgtctgtgggatgaggatgaaaagcaatttgtcacctttcgggaggcgcggaaaacaccgccgccccagcaggtgccgaaagaacctttaaagaaaaatgcctgatatggcgcgcggctctttctcttatcagaaagggcctgctctttatgtgtgaggatgcaatgaaggcggcgttttggtaaagtgatggtagacacaagcggcagaaggtggaataaggatgaagaaatattttaaatttcaaaaactgaatgggatttctccttatatatggacgatttttttcattctgcccttttattttattttcaagagctcttccacctttgtaatggcggccggcgtcattttcacacttgttttctttggcgcatatcgctttgcatttgttgcaaaaggctggccggtttacttatgggcgcttcttctgatcggcatttcgaccggctcagttatgctgttcagctatatttatttcgccttctttatcgcctacttcatcggccatatccgagacaaagttcctttttacatcttatattacattcatatcatcagtgcggcggttgccgtcaacttcagccttgttctgaaaaaagggtggtttttgacacaaattccgtttatcgtcattacactgatcagtgccatcctgctcccgctcaccattcgaagcagaaaggcaagagagcgccttgaggagaaattagaatatgcaaatgaacgaatcgcggatcttgtgaagctggaagaaaggcagcgcattgcccgggaccttcacgatacacttggacaaaagctctccttaatcggactgaaaagcgaccttgcccggaagttgatttacaaggaccctgaacaggcccgcactgagctgaaaagcgttcaacagacggcccgcacctccttaaatgaggtcagacaaattgtatcgtcgatgaaaggcatccgattgaaggatgagctcggcaatgttcggcaaattcttgaagcggcaggaattgaatttgtgtatgaagaaaaagaagcgcccaaacatatctctctgctgaacgaaaacatcgtcagcatgtgcattaaagaagccgtcaccaatgtcgtgaaacacagcggcgccaaagtatgccgcatcaccattcagcagctttggaaagaggttgtcattacggtagaagacgacggcagctttcaatgcagagaagaccgctttttttcacagggaaacggcctgcttggaatgagagaacggcttgaattcgcgaatggcagtttagccatcgatacagctgccggaacaaagctgaccatgagaatcccgaatgattcaaaatcaaaagaaaaggatggtagcagatgatcaacatcttcattgccgaggatcagcaaatgctgctcggcgcactcggttcgctgttgaatttagaagaggatatgacggttgtcggccaaggcacaagcggccaggatgccatcgatttcgtggaaaaacacgctcctgacatctgtctgatggacattgaaatgcccggggtatcaggtcttgaggcggcggaaaagctcaaggacagcgatgtgaaaatcatcattttgacgacctttgcccgctccggctattttcagcgggcgctaaaagcaggcgtcagcgggtacatgctcaaggacagcccgagcgatgagctcgtcagcgccatccgcagcgtcatgaaaggaagacgcgtctacgcacctgaattaatggaggacatctatagtgaagaaaacccgctgactgaacgggaaaaagaggtgctcgagcttgtcgcagacggaaaaaacacgaaagaaatcgcaaacgccctcagcatcaaaagtggcacagtccgcaattacgtttcgatgattctggataaactagaagtaaaaaatcgaattgaagccattacccgatcaaaggaaaagggctggtttaagtaacccgccctcagcttgttcaaccagtgtttttttacactggctttttttattatctatcgtcactccgtctcttccttccacttcttatcaatcagcatttttcccggccaagtgtatgccatgatgccgccgtctgcggtgatgtcttctcccgttacgtaagagctgtcgtctgaagcgaggaagagcgcgacggctgccatttcttccggttttccgagccggccgagcggcgtgatccatttgttggcttcacggaacgcctcgcccatttcgtcttctgtcgtgcctgccaatttatcaatgagcggcgtttcaatcgtccccggcgataaggaattgacgcggattccgcttctggcgtaatcaatggccatcgctctcgtcaggttcgtgattccgccttttgcggcgttatagcctgagcggtcaaggtctgcggcccggccggacatggaggaggtgttgatgatggagcctcctttttcgagcatgagcggaatcaggtatttgctgcacagaaatgtgccgcgcagatcgacggcgatgatccggtcaaacaggtcgaccgggtattcatggacttttccgccctcttggtcaacaccggcattgttaaacagaatatcaattgttccgtacttttgctgaatgccgtccgcaaaagactttacgttttcttcgtctgatacatcaaggtgaaaggcttctgcttctccgccgttttttctgatggcgctgacggtttcattcagttcgctttcattgatgtcaccgcagatcacgcgggcgccttcatcggcgaaaatccgtgccgtcgcttgtccgatgcctgtcgcggcccctgtgatgattgcggttttgtctgttaatcttcccatattgcgattcctccttttttatatctgttcccgctgaatagggggataaacatacggcggtctgtttctaaatagctattaaatatgttaatattatgtatatacatcattgaaggtttgcatattttgaagatccagcataagaaggagatagcgttttattgttatgccattgttcctatgggatttgtgatttacaccgttatctctattctatttcaggacatcacatttcctctcactgtaagaaatgttctgcatgagtctttgcgaaacttgggatctcttatcttatttagtttgtttttctacccgtcatacatatggatgaagaaggaattcggccgccggaaagaagcagagaggagaggatgatcaacattctctcttttttattgataaaatgggtgaaatgaatccattaacatgttaaatttacaatatatgcatctgctaatgctagttgacaattgtaactgtatatgataaatagatgctgaaaagattttacataacatcaaagcataattaaaggagagatctgaagtgcggaaaaaaaagtttaaagcagaatccaagcgattgctggacatgatgattaactccatttacacgcagaaggaaatttttctccgcgagttaatttccaacgcgagcgatgcgattgacaaaatctattacaaggcgttaaccgatgattcattaacgtttgatcaagacaattactacataaaagtgacggcggacaaagaagcgagaacgctcaccgtcaaagacaccggtatcgggatgacaaaagacgagcttgaacagcatctcggcacgattgcgaaaagcggttcactcgctttcaagcaagaaaatgactcgaaagatggccatgacattatcggccagttcggcgtcgggttttatgcggcgtttatggtggctgataaagtcacggtgaaaagtaaggcgctcggcagtgacgaggcgtatgtatgggagtcggaaggggctgccggctacacgatcgcgccgtgtgacaaggaaaccgtcggtacggaaatcaccttgaaaataaaagaaaacacagaagatgaaagctatgatgagtttttagaaaactaccgcatcaaagcgatcgtgaaaaagtactctgattttatccgctacccgatcaaaatggaagagacggtcaacaagccgaaagagggcagcgagaacgaatttgaagaagttcaggaagaacagacggtcaacagcatggtgccgatctggagaaaaaataaaagcgagctgacggatgaggactacgaggctttttacgccgagaagcattacggttttgataaaccgctgacccatgtgcatatcagcgtcgatggagcggtgcgttacaattcgattttgtttattccggaaaacatgccgtttgactattatacgaaggaattcgaaaaaggattggagctgtactccaacggcgtgctgatcatgaacaaatgcgccgacctgcttccggatcatttcagctttgtaaaaggcatggtggattctgaggatctgtcgctgaacatttccagagagatgctgcagcacgaccgccagctgaagctgattgcgaaaaacatcaataaaaaaatcaaagccgagctgaagagcctgctgaagaacaaaagggaaaaatacgaatctttctatgaatctttcggcagacagctgaaattcggcgtctataatgatttcggcgcgaataaagacgtattaaaagatctgcttctcttctattcatctaaggagaaaaagctcgtcactctggacgaatatgtgtccagaatgcctgaggatcaaaaatatatctattacgcgtccggtgattcatatgagcggattgaaaagctgccgcaaactgaaatggtggcggacaaaggctacgagattttatatttcacggaggatattgatgaattcgcgatcaaaatgctgacaagctacgaggaaaaagagttcaaatccgtatccagcgccgatttaggcatcgacagtgacgaagatgaaaagcagactgaagccgaagagaacgaatataaagacctgttcgaaagcatgaaagagattcttgcggataaagtaaagaacgtcagagcatcgaaacgtttaaaatctcatccggtctgctttgcgacagacggcgaagtgacgatcgaaatggaaaaagtgttaaacgccatgcctgacagccagcaggtcaaagcggaaaaagtgctggaaatcaacccgaaccacgaagtgtttgagacgttaaagaacgcgcacggacaagatcgggaaaagctggcattatacacaaacctgctgtacaatcaggcgcttctgattgaagggctgccgatccatgatccggtcgagtttacgaatgacatctgcaaagttatggtatgacgccaaaaaggaatcgcccggcgggggcgattcctttttttattacagtgtgcgctgtttaagaatttgattttgtttgctgcgcttctttaaggagaaccgttttttcaagtgcgtttcgatttcttctaaacttctgcccttcgtttcgggaacgatgtaagcggcgaagaagaaggatgagaggcaaatgactgagaatattccgaatacccagccgatgcccatggcgctcagcataagcgggaataccagtgaaacgatcaggttggttgccgacagaatcaatgtcgtaaatccggttgcggctccgcgtgcgtttgacgggaacagctccggcatcagaacccatacgacgggaccccatgtcgcctggtagaaaacgatatagatgccgagaaacagcacggtcagccatgccgttgaagctgacaggccggccagaaggagaatggctgatagtgacgccaggctcaaggtaatgccgacacttccccacatcagcagttttttccggccgatccggtcaattaagatcatggcggtgatacacatgatgacgtttaagacaccgatgcccatcgtgccgagaacggacgccgaagtgccgagtcctgcctttgtaaagatggtcggcgcatagtaaatcaccgtgttgataccgaccgcctgctggaagatggcgaggccgatcccgatcagcagcatagggcggatccattttgctttcagcaagccgagcgtagattcttttttctcggcttctccttgtttcatttccgccaattcaacggcgatatcctttttgtcgtgcgtcatttccatgacttgtctggcttcgtgctcacggccgcgtttgacgagccatctcggagattccggcataaacgcgattccgattaataaaagcgccgccggtactgccgcgagaccgaccatccagcgccaagcttcaaacggggtgaatatgtaattcacgatatatgcgagtaaaattccggttacaatcattaagttattcaatgtgccgagcgttccgcgtatttttgtcggcgccatctcagatagataaacgggaaccagcgccgttgagccgccgacggctaacccgagaatgacacgggagataatcagcatagtgacggtttgcgaagccgcacacgcaagcgcgccgataataaaaatgagtgaaaggacgaaaaccacttttctccggccccatcggtcagagcatgtcccgcttaaggcggacccgaaaatcgcaccgagcagtagcatgctgacgaccaatccctcggtcagcgtgtttaaaggaatatcattgttaataaataacaaagcccctgaaattacaccggtgtcatagccgtaaagcagcccgcctaatgctccgaaaaagtaaatcaggtattttttggtacttttcttcacagatgatcctcctcatcttttggaacgcataatagtttatttagataactatttcattccccgaagagaaaaatataaacataaaaaaaacacgccccttttaaaaggcgtgttttttttcttaggaaaacagcttgtcgataaacgcgatttcttcagcagatagcgtaatggaggctgctttcatgttgtcttttaattgatccgcgcgtttggcgcccggaatcaggatatcgatttcaggtctcgccaagtaccaggcaagcacgatatgcgccgtatcggcattgtgcttttcggcaatcggtttgagctggttgacttttttgatgttttctttaaactgttccccttggaaatgcgcctgatcattgcgcaggtcgccttcagggaaggttgtgttctcgtcgtatttgccggccagcagtccggatacgagcgggaagtacggaatgaatgagatgccgtgttctgtcgtataagggaagaaagtcttttccgcctcacggttcagcaggttgtattctccttgaatcacgtcgactaagccgtctttattggcttctttcagctgctccaaagagaaattggatacgccgatggaacggatttttccttcttttttcagctcattcaatgcttgaacggcttcgtccttcggcgtgtgctcatccgggaaatggatgtagaataaatcgatgtaatcagtctgcaggcgtttcaagctgtcttcgaccgattgtttcaaaaaggccggtgaattgtcgaaaacaaagtcatcgccttcttttctgtgagcggcttttgtggcgatgaagacatcctcgcggttgcattctttcagcacctcgccgattaattcttcagaacggcccacaccgtaaatgtaggcggtatctaacatggtaacgccgcttttaatcgcttcccggaccaattcttttcccgtttcttcattcagattcggatagagattgtgtccgccgaccgcatttgttcccaaaccgatcggaaatacctttaggtcagttttgccgattgttactttgctcatgttttcgccccctgaaaaaattggatatcatagcgactgccggaaaaatacggcagcgttctctattaactataacgctatgccaagtgaatgtcgatttgatgctcttggcaatacttcgtatattcctcatcgagctgctgagaagtgacgatgctgtgaagccggtcgaaaggcgcgtaagtcaaaagtgtggatttgccgaatttggaatgatccgcgagcagatacacttcgttcgccttttcggaaattctctttttcacctcgtattccagtaagtcggaattcgtcaggccgtgggtgatcgttgtcccggtagcggacatgaacgccttgttaatgttgtatttattgagtgtgctcggatcatcaatgccgacaaacgaccttgtcttccgtttgtagttattgccgatgatgatcaggtcgatatttttcatggatgaagccgcgttaataatatcaaggctgttcgtcaaaaccgttacattcttatcgggatcaagcgtctccagcatcgatttggtcgttgtgccggaatcaataaacacaagatcgtgatcctcgataaaccgtgacgcatagcgggcgattttgattttttcatcctgatgttgaatggtgcggttctcaaaagggacgagcacagatttttcggctgatgtcacgccgccgtatacctttttgataacccctttttccgcaagcttattaatatcgcgtctgaccgtgtttttagagacattgaatacctcgcacagctcatccagcgaagtggctccgtgtttgagaatgtattcttccatctcctgaatccgcatcagtttcataaaaaaactccttctagaattcttaaagtaattaaaatatataataaacaccagaagttaatcaatagttacttaacaaatgataaaaaagagggttcacaccgtacgattcgacacggttctccaagttcctgttttcccgatcaaaaaaagtatgataaaaataatgaaaaaattttgattttttagattgacttgaagatgtgttgggcttacaatgtaaccaagaaatgaccaaaatataacctgtaaaatcaaaagcgaaagatgtaaccgtttgctttttccggtacatgaccaacttttacatgggaagattgggagtcaccatcattttagcatttgtaagcgtttaattcatgtcttttatatgtaaaagatgaatatattcatccgttattatccagctgaacaggatgtttactatttaaggaggcaatgagaatggcagagatcagaaaactgaaaaactacatcaatggtgaatgggttgaaagtaagacagatcaatatgaagacgttgtcaatccggctacaaaagaagtgatgtgccaggttccgatttctacgcgggaggatgtggaatacgccgtccgctcagcgtcagaggcgtttcaaacatggtcaaagacggcagtgccgcgccgtgcgagaatcctatttaactatcagcagcttctccagcagaacaaagaagagcttgcccgtctgatcactttggaaaacggtaaaaacacgacagaagcactcggtgaagtgggacgcggaattgaaaacgtcgaattcgcagcgggcgcgccgtcactcatgatgggcgattcacttgcctctattgcgacggatgtagaggcggcgaattaccgctatccgatcggggtggtcggcggtatcgcaccgttcaacttcccgatgatggttccgtgctggatgttcccgatggcgatttcattaggaaacacgttcattctgaagccgtctgagcgcacgccgctgttaacggaaaaactggcagagctgtttgaacaggccggtctgccgaagggcgtcttcaatgtcgtgcacggcgcgcatgacgtcgtaaacggcgttcttgaacatccggatattaaagccatctcattcgtcggttcaaaacctgtcggcgagtatgttttcaaaaaaggcagcgaacatttgaaacgcgtgcaggcgttaacgggcgcgaaaaaccatacgatcgtgttaaatgacgcccaccttgaagatacggtgacaaacattatcggtgcggcattcggttcggcaggagagcggtgcatggcatgcgcggttgtgacggttgaagagggaatcgctgatgagtttatggcgaaactacaggaaaaagcagaggacatcaagatcggaaacggactggatgacggcgtattcttgggcccggtcatccgcgaggacaacaaaaaacgcacgcacagctatattgaaaaaggcatcgaagaaggagcgagacttctttgtgacgggcgtgaaaacgcaacggaagacggctatttcgtcggaccgacgatttttgacaacgtgacgacggatatgacgatttggaaagatgaaatctttgcgcccgttctgtcggtcatccgcgtgaaaaacttaaaagaagcggtggacatcgccaaccagtctgaatttgcgaacggcgcgtgtctgttcacttcaaatgcgcacgcgatccgctacttccgtgagaatattgacgcggggatgctcggcatcaaccttggcgtgccggcgccgatggcattcttcccgttctctggctggaagtcttctttcttcggcacattgcacgcaaacggaaaagacagcgtcgacttctatacacgtaaaaaagtcgtgacggcacgatacccgtctcctgacttcaattgatctgacagccggcccggacggctttgtgattccgtccgggttttcttttaccatcaattaaggaggaataaacatgagtcatttgctgcgcaaaccgcaggccgatgagatttctcaaggtgtgaacatcatacatgacgtcacttcagccaattcagatctcaaatacgtcggatttaaagtcgttgacctcactcccggttccgcatatacagaagatttgaaaaagacggagtgctgcatcgttgcggtaacgggaaaaatcaccgtcactgattatgatcagacatttgaaagcatcggcacccgtgaaagcgtatttgaaagaaaaccgacggacagcgtttatgtgtccaatgaccgctcttttggaatcacagccgtcagcggggcgagggtcgcgctgtgctattctccgtccgaacaccagcttccgacaaagctgattaaagcggaagacaacggtgtggaacatcgcggcaagctggcaaacaaacgaaccgttcataatattctccccgattcagatccatcggcaaacagccttctcgttgttgaagtttacacggacagcggcaactggtcgagctacccgcctcataaacatgaccaagacaatctgccggctgaatcctttttagaagaaacctattaccatgaaacggacccgccgcaggggtttgtcttccagcgtgtgtacacggacgaccgctcgattgacgagacgatgaccgcagaaaatgaaaacgttgtcatcgtgccggcgggctatcacccggttggtgttccggacgggtatacctcttactacctgaatgtaatggcgggaccgacacgaaaatggaagtttcataatgatccggcccatgaatggatcctggaacgctaacaagtgaggagtggcagataacgatgaaatatacatttaatgaagaaaaagagtttgatattgtcgcgatcgggcgcgcgtgtattgatttgaacgcggcggaatacaaccggccgatggaagaaacgatgacgttttctaaatatgtcggcggctccccggcaaatattgcgatcggcagcgccaagctcggattaaaagccggttttatcggcaaaatcccggatgatcagcacggcagattcatcgtttcttatatgcagggaaagggcgttgatacgtcacaaatgaccgttgacagagaagggcgcaaagccgggctcgcttttacggaaattctcagtcccgaagagtgcagcattctgatgtaccgggatgacgtggcggatttgtatcttgagccgtccgaagtcaatgaaggttacatcgcaaacgcgaaaatgctgctcgtgtcaggcacggcgcttgcgaaaagcccgtcgcgcgaagccgtcttaaaagcggtgcatatcgcaaaaaaacatgacgtaaaagtcgtgtttgagctcgactaccgtccgtatacatggcaatcggcagaagaaacagccgtgtactacacgctggtggcggaacaatccgatatcgtcatcggtacgcgtgatgaatttgacgtaatggaaaaccgcagcggcggagataacgatgaaaccgtccgccatttgtttgcgcactctgctgaccttgtcgtcattaagcacggcgttgacggatcatacgcatacagcagatcgggagaagttttccgggcgcacgcctataaaacaaaggtgctgaagaccttcggtgcgggtgattcctatgcgtcagccttcatctacggacttgtcagcggccgggatattgaaacggctttaaaatacgggagcgcttccgcttccatcgtcgtcagcaaacacagctcctcagaagcaatgccggctgccggtgaaatcatcgaactgattgaagcgcagcacagtcttaacggtaaatagaacgtataaaaggtgggatcgtttgtgggtaagacaattcgcttaacgacagcacaagcgctgattaaattcttgaaccggcagtacattcatgttgacggaaaagaagagccgttcgttgagggcatcttcacgattttcggccacggaaatgtgttggggatcgggcaggcgcttgagcaggacgccgggcacctgaaagtctatcaaggcaaaaacgaacaaggcatggcgcatgccgcgatggcatacagcaagcagatgctgagaagaaaaatttacgcggtatcgacatctgtcggtccgggtgccgctaacttgacggctgccgcgggtacggcgctggccaataatatcccggtgctgctgcttccggccgatacctttgcgacgaggcagcctgacccggtgcttcagcaggtggagcaggaatacagtgccgccgtcacgacaaacgatgcgttaaagcccgtgtcccgctattgggaccgcattacccgccccgagcagctgatgagcagcttaatccgggcgtttgaagtgatgacagatccggcaaaagcgggtccggcgacaatctgcatatctcaggatgtagagggagaagcatttgattttgatgaaagcttctttgaaaaacgcgttcattacattgaccggatgcagccaagcgagcgtgagctgaaaggcgccgcggagagaattaaggagagcagccgtcccgtcattttagtgggcggcggcgcgaagtactccggcgcgcgtgaggaattaatcgcgctttctgaaacatacggcattccgcttgtcgaaacgcaggccggcaagtcaacggttgaagccgatttcgccaacaatctgggcggcatgggcatcacgggcacactcgccgcaaacaaagccgcccgccaggctgatctgatcatcggtgtcggcacacgttacacggactttgcgacatcctcgaaaacggcgtttgattttgacaaagcaaaatttttgaatatcaacgtcagccgcatgcaggcttacaagcttgacgcgtttcaggtcgtagccgatgcgaaagtgacgctcggcaggctgcacggcttattagacggatataaaagtgcattcggcacggcgattaaagattggaaagatgaatggctggctgaacgggaccggctcggcaaggtcacttttacacgtgacgcgttcgaaccggaaattaagaaccatttctcacaggatgtgttaaacgagtatgccgacgcgctcgagactgagctgccgcaaacaacggcgctgttgaccatcaatgacacgattcctgaagacagcgtcgtcatcagttcggcgggatctcttccgggagatttgcagcggctgtggcattccaacgtcccgaatacgtaccacctcgagtacggctattcctgcatggggtatgaggtatcgggcacgctcggcctcaagctggcccatcccgacaaagaagtctattcactcgtcggcgacggaagctttctgatgctgcactcagagctgattaccgcgcttcaatataacaaaaaaatcaatgtcctgctttttgacaactcgggattcggctgtatcaacaacctgcagatggatcacgggagcggcagttatttctgcgagttccgcacagaggacaatcagattttaaacgttgattacgcgaaggtggcagagggctacggcgctaaaacatacagagccaatacggttgaagaactgaaagcggcgcttgaagatgcgaaaacgcaagacgtatccactttaattgaaatgaaggttctgccgaaaacgatgacggacggctatgacagctggtggcatgtcggcgtggcggaagtgtcggagcaggaaagtgttcagcgggcatacgaagcgaaagagatgaagctgaagtctgcgaagcagtactagaggggaggcatcacgatgggcaaacaagatattctgtggggcatcgctcccattgggtggcgcaatgacgatatgccggaaatcggagccgggaatacgctgcagcatttgttaagcgatattgttgtcgccggctttcaaggtacggaagtgggagggtttttccctgaaccctccgtcctcaataaggagctggctctccggaacttgcggattgcggggaaatggttcagcagctttatcattcaagacggtattgaaaaaacggctgaacaatttacagaacactgtgattatttgcagaaagtcggagcggatgtcgccaccgtttctgaacagacgtacagtgttcaaggcttggacattgatgtatttaagaaaaaaccgcacttcacagatgaagaatgggatacgctgtgccagggcttgaaccgtctcgggaaaatcgctgacgaatacgggctggacatggtttttcatcatcatctcggcacaggcgtccagacggcggaagaagttgaccggctgatggatggaacggacccgcggtatgtccatttactttatgataccgggcatgcctatatctcggacggagactatatgacaattctcaacaagcatatggatcggatcagacacgttcatttcaaggacgcgcggtttgacattatggagcggtgcagacaggaaggcaagtcattcaggcagtcgtttttacagggcatttttacggttcccggagacggatgcatcgattttaccgaagtataccgaacgctcgtccgtcatgattattcaggctggatcgtcatcgaagccgaacaagacccggcagtcgccaatccgcttgagtacgcgctgattgcgagaaagtacatcgacagtgaactgcttgatcctgcaaattagagggggacttatatgaatagtgccaaggcggaatcagctttcagcaaaaggaccatcgccgcagcattagccaattacattgatgcaggttccatcgtggcaggatcagcgggtttatctatgtgggtcagctatttaaagctgtccgacagccagatcggattgctcggcgccttcagtgcaaacgcgatatcagcggccgtcggagcgctgctcggcgggtatttggctgataaagtcggccgaaaagctgtatacacaaacagtatgctcgtctacgccttaggaatttgtttggttttgtttggattcaactttcccatgctgttatgcggatacatgattatcgggatttctgtaggcgcggatattacggcttcatggaccattatcgcggaaaacgcccccgagaaaaaccgggcgaggcattgcggagtggcgcaggtggcgtgggccgcaggggccgttgtggttctgctgttatccgttttggtcggtgacctcgggcttttaggaaataaaattgtctttgcgcatctattggtgatcgccctgatcacatatgtgataagaaagcgtttacctgagtcggatgcctggaaaaacagtgaagagcggcctgccgccgtgaaaaaaacatcttattttgacctgcttcagccgaaatttttcaagaacattttgtttttaatgggtgtgtttctcgtatggaatctcgcagcgggcgtcatggggttcttcatgccgtacatctaccagcaggtcggcggcgtatccgcaaatacggccaacattctgcagatggccctgtttatctttaccgggctcggcgtcgcctgtatcttcatgccttttgcagatcaatatcggaaaacggtgttcggaatctgcgcatttatggccgttgtcggctggtcgctgtttttactgccgtttcaggggctcccgatgctgcttttgtttgttttagcgatcggcatcaataacggagccggccagcaggcgaactaccagctgtgggcaagcgagctgttcccgacagaatacagagcgtcagcacaagggctcatgttctttctcgtccgtatttcaatcggcatttggagtttatttgtgccggtcatcatgtcacaattcggcatcggttttatggccggtattctgctcatatgtgtgacggccagtatgatcatcggacttgtcttcgcgccgagtacgtccggcaagtcgcttgaacagatacaggaggaactttacggcgctcctcaggacggcagcgagaaaagaaagacgagaaccattatttgattatcagaaggagtggcgatcaatgaatttacgtataggtgttatcggaaccggtgctatcggaaaagagcacatcaaccgcatcacaaataagctgtccggagcggaaattaccgctgtcacagatgtgaatcaggaggccgcgcagcagaccgttcaggatttcaatttgaacgcctccgtttatcctgatgacgacagcctcctcgctgctgaaaatgtggatgccgtcttagtgacaagctggggcccggctcacgagtccagcgttttgaaagcgattcagcacggcaagcacgtgttttgtgaaaagccgcttgcgacaacggcagaaggctgtatgcgcattgtcgaggaagaaatgaagacgggaaaacgattggtgcaggtaggttttatgcgcagatatgacagcggttacgttcagctgaaagaagcgatcgataaccgcgtggtcggcgagccgctgatgattcactgtgcgcaccgcaacccgacagtcgcatcgaattattcaacggacatggccgtcgtcgatacgctcgttcatgaaattgatgtcctccactggctcgtcaatgacgactatgaatccgtacaggtcatctatccgaagaaatcaaaaaatgcgctgccgcatctgaaagatccgcagatggtcatcatcgaaacaaaaggcggcatcgtcatcaatgccgaaatctacgtgaactgtaaatacggctatgacattcaatgtgagatcgtcggggaagacggcgtcatcaagcttccggaaccgtcaagcatcagcttgagaaaagaagggacattcagcaccgatatcctgatggattggcagcgccgatttgtggctgcgtatgatgtggaaattcaagacttcattgattcgatccggaaaaaaggcgaagtcagcggtccgacggcatgggacggttatattgccgcggtgacaactgacgcgtgcgtaaaagctcaggaatccgggcagaaagagcctgtggcgctgcaagagaaaccggcattctaccaatcatttacgactgtgaacaaataatagatcgggagtgaaagaaatgaaactggccttagatccatccatgtaccgcgatgatttaacgttagaggaaatggtctataaaacggcggagctcggatacgaatatatcgaactgtccccgcgcgaggatttttgtcctttctacaaatatccgaaagtcgattcagcaaaaatcaaacaattgaagcgccttttaaaggatacaggtgtgaagctgtcctctcttcttccgctttaccactgggcgggtcctgaagaagaccgtcgtcaggccgccgtgcgcaactggaaacgggcgatcgaaattgcggttgaacttgaagtggatttgatgaacagtgaattcagcggttcaaaatatgatcctttgacaagtgaagaaaaatttatcaaatccatggatgaactgctgcccgtttttgaaaaagaaggcgttaaactcaatcttcaggctcacccgtatgattttatcgaaacgcacaaaggtgcgatggatatgatccgcgcgcttgataaggattggatcaatcttgtctactcgactgcgcatacgttcttctatgatgacggaaaaggcgatattgcgaccatgtttgatgaagccggcgaccgccttacacatgttttatttgcagatacttttaatcataaagcggcgcacggcctgcgttacatcgtcaacccgcctgatgcgaaagtaacggttcaccaacatttggacatcgggcaaggcgaggtcgattttgagacgattttcagaaagatgagagagatgaaattcgacggaattgcgacgaacgccgtttttgcttgggtcggcgaaagagcggatgaatcaagccggaccacgcttaagaaattaaaggaagaactgggtatggcataagctgagtacggagttcggcggagcggggcaaaaaagccctccagccggactcccttcatatcgaaaacgcggatgggagaggctgacatgaaactttgctttaatgaagcgactacgctggagaattcaaacctgaaacaggatttagaactgtgcgaaaagcacggctatgattatattgaaatccgcacaatggataagctgccggaatacttaaaagaccattcactggccgatctggcggaatattttcgaacccatcacattaaaccgcttgccctgaacgcactggttttcttcaacaaccgtgatgagaagggctatagggagatcatttcggaattcaaaagcatgatggaaacctgcaggacgctcggcgtgaaatatgtggtggccgtgccgcttgtgacagagcggaaaatcttgaaagaagaaatcaaaaagagcagcgcagaggtgctgactgagctttcggacatcgcggagccgtacggcgtaaacattgcccttgaatttgtcggccacccgcaatgcacggtcaatacatttgaacaggcgtatgacatcgtgaacgctgtcggccgcgataatgtcggactggtgtttgacagcttccatttccacgcgatgggctccaatattgagagcttgaagcaggcggacggaaagaaaattttcatctatcatatcgacgatacagaagactttccgatcggctttttaacggatgaagaccgcgtctggcctgggcagggtgcgattgacttagacgcccatctgtcagcgttaaaagaaatcggattcaatgatgttgtctccgtagagctgttcagacctgaatattataagctgactgcggaggaaacgatcaaaacggcaaaggaaacaacggaagccgtcgtatcaaaatacttcatgaaggaggcgtgaacatggcttttgtcaccatgaaacatcttcttgcagaagcgaaacgggagcattatgcagtcggccagtttaatatcaacggcctccaatggacgaaggcgattctgcaagcggcgcaaaaagagcaatcgccggtcatcgccgcggcttccgatcgtctggtcgactatttaggcgggtttaaaacaattgccgccatggtcggcgcgttaatggaagaaatggcgattaccgttcccgtcgtgctccatcttgatcacggaagcagtgcggaacgctgcagacaggccattgacgccggattcagctcagtgatgattgacggctcccatcatccgattgatgagaacatcgcgatgacaaaagaagtcaccgattatgccgcaaagcacggcgtctcagtagaagcagaagtcggcacggtcggcggcatggaagacgggctggtcggcggggtccgctatgccgatatcgccgaatgtaaacggatcgtgaaagaaaccaatatcgacgctctggccgccgccctcggctccgtccacggcaaatatcagggcgagcccaatctcggatttaaagaaatggcggctatctcccgcatgactgatattcccctcgttctccacggagcatccgggattccgcaggatcagatcaaaaaagccatcacgctcggccacgcgaaaatcaatatcaacacggaatgtatggtagcctggacagacgaaacacgacgcatgtttcaggaaaacggcgatctgtacgaaccgcgcggctacatgacacccggcattgaagccgtggaagagacggtgcgaagcaaaatgagagagttcggatcagccggtaaagccgtaaaacagcaggtcggctgatgaaaacggaaaccgccaagatggcggtttttttgtgcggtgttgcgtccgtacgcccgaaacgattatgatgatggcagcagcgtaagaaacgggagtggttcagtttgaataaaatcatgattgtggaagatagtgaagacattcgcggactattgcagaattaccttgaaaaatacggatatcaaacagtggccgccgcggatttcacggctgttcttgatgtttttttgcgggaaaagcctgatgtggtgctgcttgatatcaatctgccgtcttatgacggctattattggtgccgccagatccgccagcattctacaagcccgatcattttcatctcagccagaagcggagaaatggatcaggtgatggcgattgaaaacggcggagatgattatatcgaaaaaccgttttcttatgatattgtgctggcgaaaatcaaaagccagatccgcagggcatacggagagtacgccgccaagcagggagagaaagtggttgaatatgccggtgtgcagctctttgtggaacggtttgaactgcgttttcaggacgaaaaaagcgagctttctaagaaagaaagcaagcttttggaagttctgctggagcggggagaaaaggtgacgggaagagaccggctcatggaaaaaacgtgggacaccgacattttcgtcgatgataatacgcttaacgtgtatatcacgcggctcagaaaaaaactgcgggagctgaatgcgcctgtttccattgaatcggtgcggggcgaaggctaccagctgagggcgctgtcatgaagctgtttctccggtctcatgccgtgctgattctgctttttctccttcaagggctgtttgtcttcttttattactggtttgcgggtcttcattctttttcccacctgttttacatattgggcgtgcagcttcttattttggcggggtatcttgcctatcgctggtacaaagaccgcggtgtgtatcattggctcagctcggagcaggaagggacggacatcccgtatctcggttcttcagtgttctgttcagagctgtatgaaaagcagatggagctgacccggctgcagcaccagaagctctacgagaccgaagccaagctcgacgcgcgggtgacgtatatgaatcaatgggtgcaccaagtaaaaacgccgctgtcggtcattaatttaatcattcaggaagaggatgagcccgtctttgaacaaatcaaaaaagaggtccggcagattgaattcgggctggagacgctcctttattcatcaaggcttgacctgtttgagcgggattttaaagtcgaagcggtttccttatcagagcttctccaatcggtcattcaaagctataaacgattttttattcaataccgcgtctatccgaaaatggatattcgcgatgatcatcagatttacaccgatgccaaatggctcaaatttgcgatcggccaagtcgtcacaaatgcggtcaaatattcggcaggcaagagtgacagactggagctgaatgtcttccgcgatgaagacaggacgatgcttgaagtcaaagattacggtgtcggcattccctcgcaagatatcaagcgggtgtttgacccttattacaccggcgaaaacgggcggcgtttccaagaatctacgggaatcggcctccatctcgtcaaagaaattacgggcaagctcaatcatacggtggacatcagctcgtcccccggtgaagggacatcggtccgattttcatttcttacaaaaatgtaagactgcgttaagaaaacaacatagctcattctgtttccccttgataacatggatttatgtcaaggggattttttatgctgaatgccccggcactacatgaaagcagcccagatcaacaagaataaaaccataaggaggattctcatggcgaatatgcttgaagtcaaacatataaataaaacctaacctataaaggacaagtatcctatcaagctttaaaacaaatttcattttcaatagaagaaggcgggttcacggcggtgatgggaccgtccggctccggaaaaacaacacttttgaatatcatttcaacgatcgaccggccggattcaggcgatatcctgattcacggagaaaacccgcaccggctgaagcggacaaagctcgctcatttccgccgcaagcagctcggatttgtgtttcaggatttcaaccttctggacacgctgacaatcggtgaaaatatcatgctgccgttaacgcttgaaaaagaagcgccgtctgtcatggaagaaaaactgcacggcatcgcaaaaaagctcggaatcgaagacctgctcaataaacggacgtttgaagtatccggcggacagcgccagcgggccgccatcgcaagagcggtcattcataagccgtcacttattctggctgatgaaccgacgggaaaccttgattccaaagcgtcaaaagatgtcatggaaacgatgcagagcctgaatcaggatgatcatgtcacggctttgatggtgacccacgatccggttgcggcaagctactgccgccgcgtcatctttataaaagacggcgaactgtttaatgagatttaccgcggggaaaaccgccaagtcttttatgagcagattcttgatgtgctgtctatgctggggggaaacgcaaatgacctttcttcagttcgcttataaaaacgtcacgagaaacaaaagggcctatcttgcattcttcttgagcagcgccttttccgttttgattttctttacctttgcgatgttcctgtttcatccggcactaaaggaaggctacctgaataacatcgccaaaaaaggcttaaccgccgcggaatggatgatctttgttttttctttcatatttgttctgtattcggttaacgcatttttgaaatcgagaaataaagaattcggtattctgctgatgcagggtattacgccggtgcagctgagaaagctcattacggcggaaaacatgatcatcggcgtcatgtcgatcgcagccgggattatcggaggcttcattttttcgaaaacgttctttacggtcggcgcttatattttagaaatggacgcgctgcctctgtacatgccttggaaagcgcttggcattacggccggcggatttctgctcttatttttccttttatcgcagttcacgatcctttttgtcagatcaaatacggtgatcaaattaataaagggcactgacaagatcaagccggagccgaagccgtccgtgcttctgtccttattcggcatcgcctgcctgtgcggcgggtacggcatggttctgaaaggcaatgtccacgggaccgagccgttcatcattttactgcttaccgtcatcggcacgtatttctttttcagccaaagcagcatctggattctgcgcgcgctgaagaagtggaaaaccttttatctgcgcgggaaaaatgttatttgggtttctgaccttgtctatcgtttaaaagacaatgcccgcctgttctttatcgtcagtattatttccgcggttgcctttacggcgacgggcgtgctcgcgatgtacaaatcgaccgtcggggcggaagagtccgcctatgagatggagtatttatctttcagcaataacccgaaagaacagactcatttgaaagatattgaccatgaactgaaaacacacggctttacgtataagaaagacaaaataaatgtttcctatgtccgctatcaggaaggagatactgttccgcctgtttacatgatcagcgaatcggatgtgtcaacatacttccatgtcaagctgaacgggctgaaacataatgaggctgtctatttcccgggcacgtatgaccgcaatttcaaaaacgacgcgccggatcagctgaagctgctgaaccaaaaaggcaagccgtctgaccaaaaactgacggtaaaagaagtcaaaaaaccgctgatttcactgaatgccatcatcgcggtgaacgatcaaacctttgatcagctgaaatcactcggtgagaaagcgtcattatacggctacagctatgatcattggaaagacagtcttgggatcagccaatccttgaaaaatgagatttacggcaactatatcgacgtgcattctgattttatggcaaaagccgggacgtactatgatacggtgcagctgccgagcctgagtttattcatcggcctgtttatcgcgatcgttttctttgtcgcggcagcgagtttcttatatttcaggctgttcaccgatttagatgaggaccgggagcgctaccgttcattggccaaaatcggtctgagcgagcgtgaaatggcacaaagcgtgacgatacaattggcgattctctttttctttcctttcgtcattgccgtcatccatacgctgtttgctttgagaacattggcggtggaaggctattccgatgtagcggggccgctcagtctgaccatcggagggtttttcatctttcagcttctgttcttcctcgcggtgcggacaagctatttgaaaaaaatgaacaagtaaggggagtgcacagatgaaaaaagcattggcaatcctggccgtcttggcggccgctgccgtcatatacggacttctcttttttcataatgatgttacagacagatttaatccgtttattcaccagcaagatgtttatgtacagattgatcgagatggcaaacatcttagcccgggcggtactgagtatacattagacggatataacgcatccgggaaaaaagaagaagtgacctttttcgccgggaaagaccttcggaagaacgcgtatttgaaggtgaaggcgaaaggaaagtatgtcgagacctgggaagaagtcagatttgaagatatgccgggctccgtacagtcaaaattaaagtgaacatgaaaaacggcacagtgtcatgactgtgccgctttttttattttttattttcttcagcccgtttgatcagcatgtcggtgatgatatccatctgtttgctgacggcaatcgggtcatacggatagaaggtgttgaaatcgttgataaagacacggttgttctttacggcatcgagatttttccaaacggatgactctttcagacgctcaaatgttttgctttctccattcggattgtaatcggtaatgaacatataatcagccgcatattgagggatgacctcttgggaaacctgtttcatggcgcccgttttcatgatgtctttttcgattttggccggtgctttcaatccgagcgcgttataaacggcttggccgccgcggccggaattgtcattgaaaatccagatttcgcctttatctgtcgtttcataaaggccgactgtctcgtctttgccgatcacgtttttgaggcgcttttgatcggcttctgcctttttgttgaagtctgccataaagcttttggctttatccttcgccccggcaatgtcaccgaataggctgaccgtatctttcgtattctttgcggtgttaaaaggaatgacaatcgtcggtgcgattttcgatagtttctcgtattggtcatccttcatcagcacgattaaatcaggcttcagctgcatcactttctccacattgacgggattgccgatgtccgtggtgtttttcagctgttttttgataaacggatttttgaaagcccatgagcccgccccgacgacatttgcgtcaacggacagcagctcacccgcataaaagtcagtgacgatccgtttcggatgtgcgggtatgtcaatatttccttttgttgattcatatgtacgcatgtctgtctttcctttgcctgatgccgatccgttgttttccttcgcgccgctgcaagcgcttaatgcgaaaacaagcagaagtgccaggccgatcagccatgattgtttcttcataatgatccccctattttggtgataatgattatcattattaatatagcaggaagacgtcattccgtctatgttttttatagaaaaccttccttgattatccatgttatagtagtaaaggaggaggaatgaatgttgattacgaaaagagggacttggtgggaagtgctgcacagctggtggctgctgctgactttcgcgccgtttgcgctgaccgctttcttggcctttttctatatcggctaccgggccaagaacaaaaaatggctgaaatacggacttatctattttattattttagcaattgcttttgtgctgccgagcacgccgggcgtgtatatcgtgctgcctttatgggtcatctccatcatccacgggctgaaagtgcgggcggcttatttgatacagcttgatgtgtttaaacaaaacgtcgaagcaagagcgtttgaagcggtaaggcatgaggcggaagcaaaattcggcggaaaacccgctcatcgcattgatctgacaaaacagagataaaaacaaatgacaaagccggtatctcgcgctttgtcatttgcatgaccggcctattgctggtatgaatgctgctgaaacggtgtgtgatgctgtgtttgcgggaatgaagaaacattagcgtttgtcatcggtgcaggcatgtgtccgcttacttcctgctgaagctgattgcacacattcacgatttgctggcatttctgaatggccgcttcatgcccctgcagcgcttgctgaatggtatgaacggcatgctgttcatggttaagcatctgctgaagcatttgaatgttttgctgttcctgctggagcatttgcttgtactgctgactgctttgctgcgtctgctgaataagctgctgtgctgtttggcggcattgctgcagctgatttccgctgtattggttttgatacatcatgaagacctcctggagtgattgattttacacatttatcatgtgaaagaataggagaggcattcatgcaagaaaaggattcaaatatttacctgttatgtacagagcggaatacaaggctcgggatggcctgtcgagctttgtattccggccctttttctcagaagccgccttctgtagcgtgaaaaggaatattgagtctgttttcgactgcgcgcaggcgctgattcaaacggtttaagcggcgggtatggatttcaatggactggctcagccgtctgatctgctcattcatacgcgtgatttcccggttttggcgctggtcttcttgtgagaggcgggtgagctctctcgtttgctgggcgttttgtctttcaagctgggcgactctccgttctaaagccgtcggctgccgctcttcagactgagggggcgcataataatagctttcctgctgctgatacggctcatactcaacgcggttcacttcgtattcctgctgctgagggaaataggcaggcggggtgtagtactgatatgggttcattcatcattctccttatctagtgaagtctttatacactatgtagtcaattgcacagtgccacggcatctgcctaagttacaggcgtaaaaaagcttcaaaggaaggtgatcatgttgcggaacatacggattttcatcatgacggttcttgttttcggatgcgtcatgataacaggctgctcgcaaaagaaagcagacgatacccctttttattacgggacatgggatgcagggctgaaaccgggcccgatggacggggtcagatctgaaaccgtcacgtttacgaaagacagcgtgctgacaaagcaggtcattcagggccgcggcgaggttgccatgccctcagatgtgtacaaggtgatctcacaaaacacggacgggacgatcgagattgaatacctcggacatccgcaccccgtcaaaagcacgttgaaaagaggaaaaaacggtacgctcatttggaagatatacggagaaacaaaaacaatgacaagaataaaaaccggcggggaggatgcacatgagaaataaggctgccgacagactcgttttgacgggtgtcatcgtacatatcattcaatggttttcactgttatggttattttttatgctttttgatcagttcgggcgttttaccatttacaatcccaatgtcgtcaacagcagcatgcagtctttttcattctttgatatgatgcgcgctcttctgttttccggcacgctgcggaatacgcttctgctgtttctgtttgcggcaatgctcatttacttgtgggtgaacgctctgtttatcctgctggaaatcgtttcttatatcatgatcaggcggaacagccgttcattatgggcatactttcccgcagcgatgggaataaagcttgcccttctggacatagcggccgtccctttctttgcggcggggctgatgctcttgaagcagaaaacagacgacggcggcgaacaagctgacaaggggaaaagacggccccgcatccggaggcaggcccggtatacgaagagaaggcggagaaacttgtccgtttgatttttcattgaaacgaaaaaacgatatgatgaaagcataagaagaaaaggatacaaaggagatgcaggatgtacaagttaatcgcaatagatatggacggaacactactaaacgatcatcatgaagtgacggctgaagtccgcggggcgcttgatgccgccaaagcggaaggggtcaatatcgtcctgtgcacgggccggccgatcggcggcgtgcgtcggtatttggaagagctgaacttacaggaagaaggcgactttgtgattgcctataacggcgcactcgtccaaaatacgtatacaaacggtgtcgtggccgagcagtcattaggctttgaggatttgaagtcgctttacgagctgagcttacagctggatactccgatgcattactttgacacagccaatctgtacacgccgaaccgggatatcagtgaatacacggtatacgaatcatacattacgaaagtgccgcttcatttccgcacgatcgatgaagtgccgaaggatattctgattccgaaagtcatgttcattgacgatccggacaagctggagaaagcgatcgcttccattccggaatcattcaaagaaacatacacaatggtcaaaagtgcgccattcttccatgagattcttcacccgaaagtcagtaaaggaaacgcggttaagctgctggccgaaaaactcggcattgaacagaaagacgtcatggcaatcggcgataacggcaacgacatgtccatgattcagtgggccggctgcggtgtggcaatggccaatgccatcccggaagtaagggagattgccgattttgaaacgaaatcaaataacgaacacggcgtggcgcatgcgattcaggagcttgtgctgaaaaaataggcaccccatcagagggtgcttttttgaaaaaattttaaatcctaattagaaatattgtagtaacattaaccgagaggatagttaaaatattaaagtcaatttaagaagttatgatgattaaactctttaaaatttgaaataactcttcttagctcagtatttttaatcaatagaatcccctatgatgtcttttttgttaaggaatataatggaggtaatcacacaaataaaaataattattatttgtatcaacaaggtgatcataatagaggtaaaagcattttgatgaaataggggctgtcttaaaaccatactaagatttcctataaaaacaaaggagtctctgaaaatagacagcacgtaccatgcagttatgatcaaaaaggcataaactggtttcatcattattgatagtgttgtgaagagaaaaactgcacagagtacacttgaaaaattcaacaaaatgatgaaccatgttaattgtaaataaggcatctttaaatctgaaaaactgagtgtatgcaaagcatattctgtataatttgttgactggatcccaaataaagagcatagaaaaagtgttgataaaaacattagagagcagtaaatcaacgttataataaaagtacaagtatatttactgatgataagtaaatatactttgcgcattctaattctagtaaatgagctgaaattgataatgtctgttcttgcccatgtattcataataaaaattaagcttagttgaataaacaaccataaaaaagggaatttaaaagagtgttgcttcacaagatcaatgggtatacctccaatcccaattagtaacgcatctaaatacgaataataagtattttgatcatatgattttaacagaagtactgggtacaacaaaaaaaacaacgtgacaattagcaaaataatgaagttgtttttgatatgttgaaagccagtttgcagatctctttttattagtaagatataatctttcatcgaatttcacttccataaagccttatttgtaaactgggattttgaacaaatttatagtcataccatccctagaattaatatttagttgtaatggtacagttttattcatatcattataggtgaatttagcttcacctttgattgttgtataaggagggatggaataaacccttttttttgtgcgattatcaataaagtcgatactttgcgtcatatcttccccacgcatcaaccgataaaattctggatggaatgtagcatctttattagtgtcatttttaatagtgaaaggtatggaaaattttgttattttgttcagcatgtcatcttccactacttcagtttttgctttaccgaatgcttgtgtaaggcctaaggcttttattggtgtatcaagtttagtattaacaatagataatttgtaaccagcatagtttttattagtagcacggtattgataaatgctatatgcagtaacgagaatcaaacaaattaatactaaagctaaatatagttttttcttcattaattcacattcctctcagactcccggataatacgtccacaatcaatatcaaaaattttatctgatactgcattaagtgtttcagagtcgtgactagcaactaatatggtttttccttcagcctttaatttaaataaaagtttttcaacaacttttacagcttcccgatctaaagcgtttgtcggttcatccagcattataatttgttgatcttccataatagcttgagcaattccaaggcgttgcttcatacctaaggaatactttttatatttttttttatcatcaggatttaagccgacactttcaatagctttctttatgtcattatcggaaatttttgattgaatttttgaaagtagctttaaattcttaaagccggtgtaatcaggcacaaaaccaggatactcaattaaaacgccaatattgttagggaaatttccttgctttgtcatattaattccgtttattaagatttgccctttagtagggcgcatcaatcccgatagtacacgcaacagcatagttttaccagatccattccgtccttgaaatccgtaaattttcccttggtctaattcaaaagaaatactatctagtaccgtatttcttttgaatgtttttacaatatctttagcttctatgattactttcgacatttttcgtcctccattattagttcttcttaacgttgttctcgtcaattttcccattagaataatcttttttgaccatttgtacatatattatagaaaataaaagtagtgttccgcctgtaaacagaaagactgtggtctcaaaagattctggtactaaccattggtctaaattcaaagataagtgatcatgtaaaattgaaaattcataaaagttgctcatcatacgatccataataattaaagacattacagcgataaaactatatatgtaatttgataaaaacaaatatatagcactaactgcagcagaaaagaaaaagaacacgagcgtactcgtaataaaataacgagtaatcatccatatccctgaaaaagatgagaggtctatttgatctccatatcttatataaggcgttcctgctgttgtgtcccaataatgtacaaaatttccgcaccaaatcccactaataatgtagccggaaaataataataatagtgtaaaacataaggaaataccaaacaatcgagcaattaatgctaaaaaaagttctgaacgtgatctatatctaatgatacgaaatagcgaaaaaaatggtaaaacaccaatagacacaaataaaagaaaaagtggactgagaggaaaagtaaatgtatatattgagaaaaattgatccattgcgtctgcgatactaatcgtaccttttagatcttcaagtcgtgcactcttaattaagaaaagaatagtcagtataaataagcaaaaccaacccgatatcttccacttatccgagcataaatcagttattaagtttttccattccctaatcacgaacatatttgcgaactcctagtagaaaaattattaagcttaaaagcatcactcctattaactggaagcacattgcagaccaacttgctccattgggtgcttgttgttgtaaaaaactagaggcttgcatttgatcttgtcctaacgttgtgaatacagtattaagaataaactgaagtacgaatggagataaaacaacaataaacatattgtgaaatagcatacttatactcagtgcaaaactagcccaaaccccggaaaacaaaccagtcaataatatatagaacaaaatgtgtaataatgggtgactataataaaaatcagggaaaaatgtataacctgttactaatggcatttcattattgataacacgatcaggcggaatattaggaaacttcatgaaagacaaataaagattaaaaattagaggcagcgttccagtaataaaagctgcggcaaaattcaatccaaataaagccttgaagtataaacttgcttttttccttataaataaaaaaggtgtatagccagtacgttgatcacttgcgaataaatctgctaatggaagagatactattacaggtaaaaggaacagaaacaaggtagggtagtctgaaattccaccaatccccatccacttggtataaggtgtaaatgctattccgccatctttttcaattgattcttctaaaaaaagttcatctgtataaaaataagcaacagaacaaaataagccgattaaaattgcgatataaaatgactttctatgtaatagtcggcgtaaaattagttctcccataaaatcctcctctaaacaagtaaataggtactgaaatatcagtacctaagaatttatcaataatctgcgctccaatatccattagaatggccgtttccgtcttttttagcagcaattgaagcgattactgttccagatcctttgttatcttcaagggcataattcgtcattaatactacgcccttttttcttactgtataattatgaccatgggaaacatcatgcccgtttgctttaacccaagatgtatatgaaatatttatatcctttactttttgatagacagcgctcgtagtatatttttcaagcttaccagtctcatcgtatggatttccttttaaaaacccaaaatgataactttttgacgaacctaatgttgaaattgcaaaagctttgttaatacctactaaagtaaaggtaagccctataataagagtgaaaataaaaaacttttttttcatgctctaacagttcccttctgaatcacgttttattacgaatatttatcgtagtcaggactccatactccgttagagtgcccatttccattttttttagctgcaatagaagtgcttacggtttccgcccaccaacttctataatcttcaactgcatagtttgtcattaatactacgcccttttttcgtactgtataattatgaccgtgggaagcatcatgccctttggctttaacccaagatgtataagcaatattaacatcttttacatcttgaaatacataagttgttcggtatttgtcacgttcagtcgtctcatcataagggtttcccttcaagaacccaaaatgaaatttagtgtctttaaagtttccatctggtgggctggccgctaataatttggcagtacctaaagaagtaaaactaacccccaaaagaagcataaatacaattatttttttttcacctaagtcacctctatattttttttatattaaaaatcttgtctgccacaccgtaacagtcatgattttcattcaaccaaataaaccgaagagaaacaactgctgattttcctttgaaagatggtaatttgatttgaaaatccgcatcaggtccaggatttttgtaagtttgtttccatgtaatttctttcccgttttctccacttatctttccaagtatgtaatttggtgtaggatgttttaattccttaaccatttcaatcttattatgttttgggagagggacaatatctgtcttttttcctttaagtatttttttaatatcagcatcattcttctctacttgtttactgtaaaaaggaccattcttaaaatcagatgaccaaaatatttttttgaaataaatatttttcgattcagagtctaaccaaaagtcattattttcgctcttagggtctttagaggtatctgttattacaactattggttctgataccgaatctgtaaccatcttgacttcattatttttaccacaagcagaaattattaagagggatgctgtaaaaaatagtgtaaggattattttcttcactaaagaacacttcctcttatttaatcgaaaaatcttcaataaactaataataaatatattatttttacatgtaaactagttttttctatttttttgagtatttattcatatagttaatataaaacatagatcgcgagataagttgaaaagcaaaggacgacagtctttcaaatgcggtatacttcaggtatatataaaattaaagtcgttaccaggaatatgaaagtttcttaacgggagattaaatttctatattggtttaaatgaataatcaaatttttattcatattcatttttagaaaaataccctctaaattgagcatgttttattaatgagtcttaaatatcacctttgaagtggattaaccctccgataatggagcgtatacattactttaatgttaaaataaattgaagtactgtgataatgaataaataatattgattcaaaactggaggcgcgatatggatcgtgaaaaacagcagctcagcatagaagcggcaaaactatattatcaatcagattacagccagcagcagatcgccgaacggcttgatctgtcacgccccaccgtttcaaggctgcttcagtacgcaaaggaaaaagggtatgttcaaattcgcgtcatggacccgtttgaggatctggacgaactcggcgcgaagctggaagaaaaatacgggctgcttgaggcgcacgtcgtcttttctccaagcgacgattaccaggccattacacattacttaagccgctatggcgcagactatatgcataaaaccgtaaaggacggcgatatactcggcgtaagctgggggacgacgatgtaccagatcgcaagccgcatggagccgaagcaggtaaagagcgttgaagttgtgcagctgaaaggcggcatcagtcattccaatgtcaatacgtattcgtcagaaacgattcagctgttcgccgaagcatttcagaccatgccgaggtatttgccgctgccggttatatttgacagcgccgatgtgaaacagatggtcgagcgggacagacatattaagcggatcattgaaatgggcagacaagccaatatcgccctgtttacggtcggaactgtccgggatgaggcgctgcttttcagactcggctatttccgggaagaagagaaacaattgctgaaagcgcacggggtcggcgatatttgttcgcgcttttttgacgaggaaggcaggatttgcagcagcagcattaacggccggacgatcggagtcgagctcagcgacttgaaaatgaaagagcgttcgattctggtggcgggcggcagcagaaaatgcaaggccattcacggtgccctcaaaggaaagtacgccaacgttttgattaccgatcagcatacggccaaaaaactcattcaagaattgtgacaattcatgaacataatttcaattaccaatttacatatgttcaaaattcggttattctaaacgtatcctaggaaaaaggaagtgcatacaatgtcaattgcaagtcaaatagaccatactgctttgaaaccgcatacacaaaaagcggatattttacaactgataaaagaagcaaaagaatataaattcgcttccgtttgtgtaaacccgacttgggtcaaactcgcagcggaggaactgaagggcacgggagttgacgtttgcaccgttatcggatttcctctcggcgcaacgacatcggaaacaaaagcatttgaaacgaaggatgccatctcaaaaggagccactgaggttgacatggtcatcaatatcggcgcattaaaagacggcgatgatggagcggttgaagctgatatccgcgcggtagttgaagcagctgataaaaaagcgctcgtcaaagtgatcatcgaaacatgccttttgacagatgaagaaaaagagcgcgcgtgccgcttagcggtatcagcaggcgccgatttcgtcaaaacgtctaccggtttttctacaggcggggcaacggctgaagatatcgctcttatgagaaaaacagtcggaccggacatcggggtcaaagcatcaggcggcatcagaacaaaagctgatgttgacagcatgatcgctgcgggcgcgagccggatcggcgcaagtgcgggcgtctctatcgtgagcggcggagacagcggcagcagcgactattaatcagcagtgcggaagctgaaagcttccgccatcctctttctttgttgatgcataaaaaattgtaagcgaatacaaataaaaggagaacacatatgaagtatctcatcggaattatcggaatcattgtgtttttaggtcttgcctggcttgccagcaacggcaaaaaaagaatcagaatccggccgatcgccgtcatgctcgtgctgcagctgattctcggttatattctcctcaacaccggtatcgggaattttcttgtcggcggttttgcaaaaggatttaactacttgctggaatatgcatcagaagggattaactttgtattcggcgggcttgtgaatgcgaaacagacgacgttcttcatgagcgtgcttctgccgatcgtctttatatccgctttaatcggaattctgcagcattggaaggtcctccccttcatcacgaagtatatcggtcttgcgttaagcaaggtgaacggaatggggaaaatcgaatcttacaacgctgtcgcatccgcgattttagggcaatcagaagtctttatcagtttgaaaaaacagctcggttatcttactgaacagcgcttatatacgctttgtgcgtccgcaatgtcgacggtctcaatgtcgatcgtcggttcttacatgatgatgctgaagcctgaatacgtcgtgacggcgcttgtgctgaacttattcggcggatttatcatcgcttctatcatcaacccgtacaccgtcagcaaagaagaggatttgatcgtcgttcctgaagaagaaaagcaatccttttttgaagtgctcggtgagtatataatggatggattcagagtcgccgtcgtcgtagcggcgatgctgatcggatttgtcgcactcattgccctgatcaacggcgtttttaacgcggtcttcggcattacattccaggcgctgctcggatatgtattcgcgccgtttgcgtttttaaccggtattccgtggaatgaagcggtgagcgccggaagcattatggcgacgaaaatggtatcgaatgaatttgtggcgatgcagacactctcatccggcgatttccatttcagtgcgcatacacaggcagtggtatctgtattccttgtctcattcgcgaatttctcctctatcggaatcattaccggtgcggtgaaagggctgcatgaaaaacaaggaaacgtcgtcgcgcggttcgggctgaagctgctgtacggcgcaacactcgtcagcttcttgacagcggcgatcgtcggattgattcactgaacataaatgaaggacaggtgatagatcatgagaatggtagatcttattgtaaaaaaacaaaatggaagagaactgacaacagaagaaattcaatttttcgtaaaaggatacacggacggaagcatccctgattatcaggcaagcgcgctggctatggcgatttactttcaggatatgacagatcaggagcgcgcagatctgacaatggcgatggtgaattcaggggaaacgattgatctctccgccattgaaggcattaaggtcgacaagcactctacgggcggggtcggcgacacgacaactctcgtactcgcaccgctcgtcgcggcgctcggcgttcccgttgctaaaatgtccggccgcggtcttggccatacgggggggaccattgataagctggaagcgatcgaaggcttccatgtggaattgtcaaaagatgaattcatcaagcttgtgaatcgcgacaaggtagccgtcatcggacaaagcggcaatttgacgcctgccgataaaaagctgtatgcgctgcgtgatgtaacgggtacggtgaactccatcccgctgatcgcaagctcaattatgagtaaaaaaatcgccgccggagcagatgccatcgtgcttgacgtcaaaacgggggccggcgcgtttatgaaaacggatgaagatgccgtgaacctcgccaaagcaatggtccgcatcggaaacaacgtcggccgccagacgatggccgtgatttctgacatgtcgcagccgctcggttttgcgatcgggaatgccctggaagtacaagaagccattgatacgttaagaggggaagggcctgaagacttaaacgaactcgtcctcacgctcggcagccaaatggtcgtattggcgaaaaaagctgagacattggaagaagcgagaacgaagcttcaggaagtcatgaaaaacggcaaagcgcttgaaaagttcaaagagttcctgagcaatcagggaggagacgcttctgtcgttgacgatccgtccaaacttccgcaggcggcgtacaaaattgacgttccggcgaaagaagcgggtgtcgtttcagaaatcgtcgctgacgaaatcggcgtcgcagcgatgctgttgggcgcgggacgtgcgacaaaagaggacgaaatcgatcttgccgtcggcattatgctccgcaaaaaagtcggtgacaacgtcgaaaaaggcgagccgctcgtcaccctttacgccaaccgcgaaaacgttgacgacgtgaccgccaaagtctatgacaacatccgcatctcagaaaaagcggaagcgccgaaactgattcatacgctgattacggaataagagaagaaaggcacatacctcatcagtatgtgccttttttatggcatggttttatccaaatgaatgtcacggacggattgtttcggctgtttctttctcaaaaaacgaatgagatagcacaggatcatacaaggaattccgcagaagagggcgattctttgattgggatcaaatgcaaggcctacgcatgaagcgaaacataagatcacagcggcgatcggaacgagagggtataacggtgtgcggaaggtcagatccgagacgcgtccgccatttttcacataatgttttcgaaataacagctgagacagggcgatactcatccacaccacgacgccggcaaatccggctattgccacgagcaccacgtagaccgtgcccggggcggcgatgcttgagatcaaggatatgcaggaaacggccatgctggcgagcagggcattcagcggaatgcctttcggcgtgacttttttgaaccgggcgctgatcatgttttcattcgccagagaccacagcatccgggtggaagcatacagtccggagttggcgaccgaaagcaaagccgttaaaatcacgaaattcatgatatctgcggcgtatgggataccgatttgggaaaagaccgcgacaaacggactttcaatcacaccggcttccctccaggagatcagtccggacagcacaaaaatggcgccgataaaaaagatgaccgttctccaggcgacatttcggatcgaacgcggaatatcttttgccggattggcggtttcacccgcggtaattccgatcagctccgtccctgaaaaggcgaaacttacggaaatcattgcgatgaaaaccgcaagaaagccgttcggaaacagtccgccgtgtgaggtgaaattcgacagcatcggagcttcacccgaaccgtgcaatgaaatcaaaccgaacatcgcggcgccgcctaagatgataaataaaaggatggtaacgattttgacgctggaaaaccaaaactccgtttctgcaaacaatttaacggagaatgcattggcggcaaaaaggagagccgcgaaaatcgcgctccacatccagacgctgctgtggggaaaccagcgctgcatgaggataccggaagctgtaaactccgatcccaccgtcaccacccaattcacccaatacatgataccgaccataaaacccgtggacggcccgataaacgttgtcgcatacgtttgaaatgaaccggtcacaggcatggctactgacaattctccgagacactgcatgacaagatacatcatcaagccgccgattaagtaggcggcgatcgtcccgcccggcccggcctggctcaatgtataccctgtgctcaaaaacagccccgtgccgatgacccctcccaatgaaatcataaataagtgcctgcttttcatcgtgcgctttagttgattgccgccttgatcaacatccatcgtgatctccccctttttgcgtggcgtgagaatcttccggcagccgagagcacgcgtgccggatttgactttaacgtgacaatttaaatccctttaatgcatgtaaaatgacatgtgcggctgcccggcttgtcatatcgcgaaaatcaagtgtcggatcaacctcaacgatctcaatacccgagatgtcagcctcttgggctaaaaacctgaccgcctgaagcagttcttcggtatacagacctccggggccgatcgcaggacagccgggcgcatgagcttgatccagcacatccatatcaaccgaaataaaaatggcgtcggctcttttttgaacggccggcaagacctcttgtatcgttcggaggagccctttctcccggatcatctccattgtatgcacgtctgcctgccgctcttttacatattgttcatatgccaagctgttgctgaactccctgattccaagctgaatcaggttttgtccgcttatgatattttcatctaacagccggcggaatggcgtgccgtttgtcggccctccgtcttctgtgttgcggacgtcgtggtgggcgtcgaattgaaagacggctgttgttcctttcgtttccgcaatggctttaatggtggaataactgatggagttgtcgccgccgagaatgacgggcacccagtcaggctggtccgtcagaatgtcatgaatggtccgataaatgtgttcgtgagatgtgacgacatccgtgacgtgaatctgaatatcgccgatatcgtacagatggtcaatgacatgctcccgcagctctgcggaatatgcggaaatgccgccgagcgcccggcggatcgcaccgggtgcaaagcaggcgccggaatggctgattgacgacttagaaagcggaacgccgatcaaagccggccctttgatcgtttgtcccgcccacgcttccgtcacatcgccgatccttgtcacatggcggtcgttgaagagagagccggctttttgcagaaacggatacttatccaagagcggctccctcccttgaaacgaccgtctttccgttcttgatgacacggcggacatgattgacgccgtaatgatacgggatatacatgtaattcggcgcttcccaaatgacaatgtcagccgcccgtccggctttaatttgtccggcctcttcgccttttccgatcgcatacgcggcattaacggtgacagcatgccagatttcttctgcggtcatttttaaatgaagcgcggcaatcgacatgatgagctggagattttccgtcggtgagctgcccgggttgaagtcagtcgccaaactgacccgtacgcccgcatcaatcatcttccgggctctcgcataagtgtgtttgccgagatagaaagtcgtgcccggcagcaggacggcgatcgttccggactccgctagcttttcgatgccttcgtcagacgcccccaccaaatgatcggcagaaacagcatgcagttctgccgccaattccgcgccgccgagcgggtcaatctcatcagcatggattttcaggccgaaaccagcttcagacgcctttttcaggtagtccctcgactggctgacggtaaagacgcctgtttctgtgaaaatatcggcaaattgcgcgaggcctttttcttttatttcaggcaaaagccgcagcatgcgattcagaaattcgtcagggctgttccggtactcaggcggaatggcgtgtgcccccataaaggtcgtgacaaggtcgaccggctggcgcccgcccagttttttcgctgcggtcagctgtttcagctccgtgtctttgtcgagtccgtacccgctttttacttccgcggtcgtgatgccgtatgacagcatgcgtccgaggtgaaaaagccctttttcaatcagttcttcttcggaggcggctttcgtgtctttgaccgttgacaaaataccgccgccttgcgccagaatatccaaataggacatgccctgaatttttaaattcagttctttttcccgggaccctccgaatacaagatgggtatggggatcgacgaggccgggggtgacgagccgtcccccgcagtcgatgatgtctcgtgcctcgtatccttcctccgctccttgatgtccggcaaaaacaatgcgcccgtcgtgaatgccgatgacggcatcttccgtgacatgaagatcctgcatgcttccgcctgatcgggggccgccggattccatcgtcagcagctggccgatgttggtgagtatggtatctatttgtttcggcatgttaccgctcctttttcatcggtatcataatgtcttgttcctcggcgacttgagccgctttttcataacctgcgtccgcatggcggatgatgcccattcccggatcgcttgtcagaacgcgggaaagccgttgttccgcaagcaggctgccgtcggcgaccgcgaccattcccgcgtgaagggaataccccatgccgacgcccccgccgtggtgaaaagaaacccagcttgcgcctgaggccgtgttgatcagcgcgttcagcaccgcccaatcgccgaccgcgtcgcttccgtctttcatcgcttctgtttcccgattcggagaggcgacagatccgcagtctaaatggtctcttccgatgacgatcggggctttcagctcgccgtttctgaccaattcattgatggcgagccccatcttttcccgttcaccgtagccgagccagcaaatacgggacggcaggccttggaatgtgacttttttctgtgccatgtcaatccagcggtgaagggcttgattttctggaaacagctcttttaataaagcgtccgtgcggtatatatcttcggggtctcccgacagcgcagcccagcggaacggcccttttccttcacaaaataacggccggatgtaggcgggaacgaatcccggaaaatcaaaagcatcggcgagaccctcatctttggcagcctggcggatattgttgccgtaatcgaagacgatagccccttttttcttgaaggcaagcatggcttccacgtgctttttcatactttgcttggatagccttacgtataaatcgggctgatcccggcgcagacgcccggcctcttcaagtgagtatcctgccggaatatagccgatcagcgggtcgtgagcggaagtctgatcggtcacgatgtcaatatggacgccgcggttcaaaagctcatgatgcacctcagccgcattgccgagaaggccgatcgataaaggttctccggcttgtctggctgcttcggcccagcgcagcgcttcgtcaattgatgcggttttacggtcgcaatagtttgtttccatccgtttatcaatccgtgtttcatccgcttcaacggcgatgaccacgccatcattcatcgtgacggacagcggctgggcgcctcccattccgccaagaccggccgtcagcgtaagggttcctttcagactgccgccgaaatgctgtctcgcaagctccgcaaaggtttcataggtgccttgcaaaataccttgtgagccgatataaatccagctgccggccgtcatctgcccgtacatcatcagcccttttttctcaaggtcatggaaatgcccccaatccgcccatttcggcacgagaaccgaattagccagcaggacgcggggcgcgcggctgtgcgtgcggaacagtccgaccggttttccggattggatcagcagtgtttcatcatcttttaacgttttgagggagcgctcaatcgcgtgaaaagcatcccagtttcgcgcggccttgcctatgccgccgtatacgatcaaatcctccggcttttcggcaacctccgggtcaaggttgtttcggagcatgcggagcacggcttcctgctcccatcctaagcattcaagttcggtgccacggccggcgcggattgatttctttacatcagtcatcttgtcagtcccccttcattggtcatcagtttttggtgatgctcattcggcagaaaagactccttcttcagccagtcactcagatgctcgatgtcataagaaaacacgcggtcttcttgtatggacggcacgatgtttctcatttcaagatagagctgttttgtgtacgaagcgcaatgttccgcaccccggtattccacggcctgcagcgcgcaaatggcttcaacggcaagcacccgcctcgtattcgcaatgatctggtaggcgtgccttgaggcgatggttcccatgctgacgtgatcctcctggtttgccgatgaaggaatggaatcgacactggcgggatgggccagggttttattttctgacacgagggaggccgccgcatattgcatgatcatcgctccggattgtaagccgggctgagggctcagaaagggcggcaggtcattcagctgcggattcacaagccgttcgatacggcgttcagaaatattcgcaagttcggccgccgccactttgagaaaatccatggcaaaggcgatcggctgtccgtgaaagtttccgcctgagatgattttggcgccgtcttcgaaaatgagcgggttatctgtcgcggcattcatctcaatttctaatttttcttttacatacgctaatgtctgccatgatgcgccgtggacctgagggatacagcggatcgaataggcgtcctggacacgcagctccccttggacggtcgtcagcttgctgtctgacaagtaatagcggattcgctctgcgacatccatctgttcctgatatccgcgggcggcatgaatgtcctcgtcaaacgcatcgataatgccctgaaggccttcgatcgttaagctcgcgatccgttccgactgataggccagcttttcggcctcgagataagcgatcagccccatcgcggtcatggcctgcgttccgttgatcagcgcgagcccttctttagaggtcaggacggccggctgaaggtttgtcttttctaaagcatgagctgtcggcatccgggccccttcgtaaaagacttcgccttgcccgataagcgccagtgcgagatgagaaagcggcgccaaatctccgctcgcccccagtgacccttgctgcgggatgaccgggtgaatgcgatgattgaggtacgcgagcagttgatcaatcagctcagtccgcacgccggaaaagcctttcagcagggcattggctcgcaaaagcagcatggcccgcgatacagattccggaaacggatcaccgacgccgcacgcgtgagaaagaatcagattcagctgcagatccgcggcgtcttctttttgaatcagcacatcgctgaacttgccgaatcccgtcgtaatcccgtaaatggtcttctcttcctgaacgatccgtttaaccgccgccttgctttttttcacacgttccatgctttcggcagatgcctgaacctcttcaaaatcaaacagcacacgctgggcatctgcggttgtcagtgaggaaccgtctaacgtctccatcatttcaaccccttttcctttactttggtaaagcgcccatacaaaaaggagctatgccatgaaaatgatatttcacgcatagccccctatcatctgaaatctatgggctgattcatatgtgattaattccgaccccgaatgtttcgtgctcaagccccttaatcggagccccgatcgtgccgtaaagtgaaacggcgatccaatcgccttccgcctcgctttcatacggatttccccgcaagacggcaaacttcaggcccacggtacgaagcagcgagccaagcagcatttcgccccgcgtcactccgtgcaaagcttccattgtggcatgatacagcgcatgtgattcgcgataaccctcagattgaatgacgccgctctttttggaagcggtttcaattgcagctaccaccttatgcgcatccattgaacccaccctgccgagacagactttccagccgtcccgttccagccggctgatctgctggttttcttcagtctcatgaagcagaagaaggacggacaatcgcccgatgcggcggtctttgtgtaaggtcatatatgcttcactcaattcttaaatattctgataactagtaactgttttttatattaagtgtttgcgaatcagaagtcaaaactttttttccagtctttcacaaatcagattgctatcgaagtaaagcggtacatcgtgaagccggcgctgttgatcacatatttccgccatccgcgtcataaaatggagcgttgtcttgaaagcgttttaagaaaagaagagagcgaggcgatttcagaaaatgaaaaccagtttctttcgtgtgtgcctggtctcagcagcggtcatcgggttcactctgccgcaggcaaaagcccagcatccggttttttcagaggtcagcgtgcatgatccgtccgtcatcaaaacaggcaatacatattatgtattcggctcgcatttggcttccgccaagtcgaaaaacctgatgcagtggcagcagatgtcttcaagcgtcaatcccaataatcccctgatcccgaacgtctacaccgaattaaaagagacattcgactgggcgcagtctgatacgctgtgggcgccggatgtcgcccagctgtctgacgggaaattttacatgtactataacgcctgtaaaggagactcgccgaggtccgctctcggtgtcgccgtgagtgacaaaatcgaaggaccctacaaaaacaaaggcatctttttgaaatcgggcatggaaggaaaaagcgaagacggcacgacgtatcatgcaaacgttcacccgaacgtcgtagatccgcaaacgttttttgaccataaaggcaagctctggatggtgtacggctcttactccggagggatttttatactggaaatgaatccgaaaaccggtttcccgctcccgaaccaaggatacggaaaaaaactgctcggcggaaatcacagcagaatcgaaggcccgtacatcagctacaatccggaaacgaaatattactatctgtatctgtcattcggcggacttgacacagccggcggctacaatatgcgtgtggcgcgttcccaaaatccggacggtccgtactatgacgccgcaggccataacatgcttgacgccaaaggaaaagacggcagtttcttcgatgacaaagcaattgaaccgtacggggtcaaactcatgggcggctacagcttcgcctcacaatctgaaaaaggcacgggctacgtctcaccgggacataactccgtgttttacgacgggaaaacgaaacgatcatacctcattttccacacccgtttcccgaacagaggcgaagagcacgaagtcagagtgcatcggctgtacatgaacaaagacggatggcccgttgcagcgccataccgctatgcgggagaaccggatacacacatatcggcggccgccgcatccggaacctacaaactcatccagcacggaaaagacatcacggctacgatcaaaaccccaaaaaacatccggcttaacaacgacggcaccatttccggggaaatgaccggaacctggacaataacggacagcagcaaagcccgaatcaacctgaacggcacaaattatgacggcgtcttcctgaaagaatgggactcagcgagggagaaggaagttgtgacgtttagtgtgctgagcggtgatggggaggctgtttggggagtgaagtgaaccaaaaaaacgccccttctactttaaagagagtatatattcatttaatatgatcgtataaacaatgttctgatttatgaacacttaactgtttctttttatttgaataattgaatgaataaaggagcaccactataagttcttagtaagtaattaaacaataatgagtcaatgtatatgtaaaaactggagaacctttaaccaatgagttacaatatacatattctaataaaagaaagaggtcaaaatggggattcagacgagaaatggaaaagctcttgaatatgcatttctacaatctttgagtaatagcctttgtactgaacaaattcaaattcttgattctgatcaattaacaacagcgagagatgcctatttagcatttgattcagaaaaaattgatgacatgaataaagcatccatggctggtgtaatggagattttaaagctagaacctggtctattaaatggagagggacttctctcgttagcaattcagcaagattctaaagggcaaactggagatgttcgagatgttttagcaatgcgtggttttgaaaaatgggaaattggattatcctgcaaaaaagatcacaaggctgtcaaacactcgcggctatctgcaagtattgatgtaggagaatcatggtttggatttaaatcaacggatgagtattttaaaaatattattccgttattcaaagaattagatgaactgaagcagaaagggttattttggagggaacttgagaataagtccgaaaatttttataagccagtattagaggcattaaataacgaactcaaggtgctagacggaatgtatccaggtgaaattcctaaaagattattaagttatttacttgggagacatgatttttataaggccatagtagacactaaaaataaaaccactgagatacaagcatttaacctttatggaacgctaaataaaatcatacatggaaatagaccaaaattaagggttcctcagttaaagttaccaaagagattttacgatatacattttaaagaaggatacaatactacgctaataattgtatgtgatgaaggctggaccatttctgctagaatacataatgcaagttctaaggtggaaagctctttaaagttagatgttcaaatagcaggcttgccacctacactttaccgacaagtagtgtcttggaattaaatcgtttagattaaaaaggaggagattatctgacctcctttttcgtttggaatttttgtcttttaccactattgatggctttgttaatttaaaatccgttttttccataacattataacgatttctcctcttaatctagtgcttattttattcttcaaagtttccccttgttttgcgagagatgacagaaaaatggtatggtaggctgctcttttctacaataaataaccttaaaaaatgtttaatatcatctcatcctgtttccttcattttcaatgtgtgctaattcctttcctattatataatttaaattattacattttaaacaaacgggaacacttgtttgctttaactagatgtgttatatttgattttatattaattagtattttaaattgcagtttttgttctatatttgttttaatttactattcgtattctcttctggcctttttctttattaagtgttaaaatgatcttagcatggaggtgtaattatgaagactgaagatagagggcgtgcaaagtaccgcccaatgaaagactatgatgccaatgaggttaaagcgctacttttagataaaataagtattgaacaagaagctgctcaaagacttgacaattttaatgaaaaaccagaacctttattgtacgataacgaaaaactcaacttgacaagtttattctctggctgtggaggtttagacctcgggtttgaattagctggtctggatgctataaaaggaattaaaacaaccaatgaacttaaaaaagataaagatttatttttaaagcatagagaagaaagcatttttcatactgtctattcaatagacatgtttaaagaagctaaccaaacatataagttgaattttccacagcatgtttttcaatctgaaaaggacatcagaaaaattaaatttttcccgaagagtgatattgtattaggtggttttccgtgcccaggttttagtgaagcaggaccacgtttaatagatgatgagagaaactttttatatatacattttattcgttgtttaatacaatctaagccattttttttcgtggcggaaaatgttaaagggatgcttactttaggtaaaggtgaagtcattaagcaaataattcaagattttgaatcagctggatataaggttaaatttaaactaacaaatgctagagattatggagtgcctcaatatagagagcgtgtatttatagtcggagttcgtgaagatttaaactttgattatgaatttccaagtgagactcatggtgagggtagattaccttacgtaactcttaaggacgctattggcgatttagaagaagatccgggagattggtatgaaggtagcttctcttctatatatatgtcacgtaatcgtaaaaaaacttggaatgatcaaagctttactattcaagcatctgggagacaggcaccgttacacccgggaggtagccctatggttaaactaggaacagatcaatgggggtttgctgatggaatagagcttaatcgaaggctgtctgttaaagaaattgcaagaatacagacatttcccgactggtttaaattttcagatggagatatttctaaagaaataagcaaaaatggacgcttaaataaagtgtataaacaaataggcaatgcagtacctgtagaacttgctagagcaattgctagacctatagcagagtggagtcatagaaacaaaaaagagttaacttcaaaaagagaggagattcaacaattagaattgtttgataggtaaaggggtccttttgggatctcttttttatgtttaacaattaatttggaggatataaaaaaatatacgcaatgagaaggagtgttgaagatgcgcagggagacaatagagcagagaaggaaaacaatgcaatcaataaaatccgaatcaaagctagaacagagaataacttctgaactttggagaaggggattgaggtttagaagaaatgttaagtcattattcggaaaacctgatattgcaataaaaaagtataaaatagtaatatttattgattcatgcttttggcataattgccccaaacacggtcatattcctaaaagtaatatacagtattggaacgaaaaacttcttagaaataaaagaagggataaaaaagtaacaaattattatttagataatggttggaatataatgagagtttgggagcatgagtttaaaacagattacaataaagtaatagatgaaattgaaagtttcattgttgagcataaaaaatgaagaagtcacactaataaatcatgcgcataaacataaaaagtaaattcttcacaagtggaattacttctacttatttccttttctaattgtaaattagaattataagattgagcattgttatatttagatataaatctaacgcccggtatttcattatgtggagaaggaaaatgatacatttttctgtatctaacaatgccatcctgaaaggatccgaattttttttcttggctattgcgatgtgtaaaagacaggtttctatcattgttgaaaaagtcaccatctactaatgtaaaatcttctaggtagccaaattgcctgtcctttatgtaacgagctattacataataacattctctttcttcattattatgtaaataacccccacaagggatagtagagttaaattgaattaaacctttagtttttgtagacttcaactcaaagcccacattttgaacaataaaatctggatgggagttcgatcctaaagtaagagggtttagatctttcagaccatctaaaaaccaattgcttaaaagttcagagctcttctctaaacgtatgttaggatttctgtgtttatacaattttttgcaacaacgatcaaatacttctatagctattttcaaatcatcttctttagtcttcataattgattgtcccacctatcttttttatagaatatcataacctactttaattttataaatcaatttatttaaaaaattaaagtagaggatttgataggtctttttatccgaataacctatcatgaaacatggtaacagtctaaataggcccgattttacttagaaggtgatgcctcatgctggcagtaatgagcgcgttacattcggcaagaactgactatgctatggaacaagagcttagattatgagctgtaacgagcaaatatggaataacaaattagaaatgttttttaaatgtatattagtggttgccctttataaaaactcaaaagaagtgccttttgagttttcacctaaactatttaaagaacaatatgtaaaaggatctcacttttaaaaatgtaagcgttgacacccaataaatccagtgctaaagtatacatatcaacccaatatcattcacccaggattgttactgcaaaccgcaggcaaaacctaaattgcgtcagacagggggagacccccgtgttctgtgcagtttgggttttttttatacccttttttcggaggtgatgctgatttcataacaaaaaagccggagaaaggcggccacctttcgtccggcagttcccccatttttaaggaggtatactcatggactatcataaaatatcaaaagagattttacaacttgtcggcggggaggagaatgttcagagtgtcatccattgcatgacgcggcttcgttttaatctgtatgacaatgcgaaagcagatcggagcgggctggaacagacggaaggcgtgatggggacaaatatcagcggcgggcagtttcagatcattgtcggcaatcatgtgccgaaggtgtatcaggctttgatggagagcagcgggctcagtgatgaaagcgcaaacaaaacatcgaaacagaagaaaaatgttctgagtgctgtatttgatgtgatttccggcgtgtttacgccgattctgccggccattgccggagccggcatgataaaagggcttgtcgcgctagcggtgacattcggctggatgtcggagaagagccagactcacagcattcttacggctgtcggtgacggtgcgttttattttctgccgcttttgcttgcagtaagcgcggcgagaaaattcagatgtaatccgtacgtggcggccgctgtggcgggtgcgatcctgcatccggatttaacggccctgcttggagcagggaaaagcatctcctttatcggtcttcctgtaaccgctgccacgtattcatcgacagttatcccgattttgctggcgatctggctgatgtcctatgtggagaagggaattgaccgaatcactccttcatctttgaaattgattgccgttccgatgcttacgcttgtgatcgtcgtgcctgtcaccctgatcacagtcggtccgctcggcgcgattctcgggaattacctgtctgtcggcgtcaatgatttgttcaatcatgcgggcattgccgcgatgattctgcttgccggcacgttttcgctaatcattatgacggggatgcattatgcgcttgtgccgatcatgatcaataacattgcccaaaacggacatgattacattctgcctgcgatgtttttggcgaacatggggcaggccggcgcgtcatttgcggttttcttgaaatcaaaaaacaaaaccttcaaatcactcgcgtttacgacgagcattacggcattgatgggcataaccgaacctgccatgtacggcgtcaacatgagattgaaaaaaccgttcgcggctgcattaatcggcggcgcggcaggcggtgctttttacggtgtaacgggtgtcgcttcctacattgtgggcggaaacgccggtctgccgagcattccggtctttatcgggccgacgtttctttacgcgctgatcgggctttttatctcgtttgcggcgggtatggcggcggcacttctgatcgggtttgaggatgtacagtccgaacgggacaaagcatctgaaacgccgggtgtgacggcaggcggagaaatcattcacagcccgattaaaggcgaagtgaaagcattaagcgaagtgaacgacagcgtcttttccggtggaatgatgggaaaaggttttgcgattctgcctgaagagggcgcggtggtttctcccgtagaaggcagggtgacagccgtatttaaaacaaagcacgccatcggcattacgagcgcccggggagccgaaattctcattcatatcgggcttgatacggtacggctggatggcaggcattttgaaatgcacgtcaaagaaggcgatgccgtcgcaccgggagatctgctgattacttttgatatcgaagagataaaggctgccggttttgacgtgatcacgccggtcatcattacgaatacggatcaatattcatttacagacgtgaaaaaaagcggaatggtcaaaccgaacgaagcgcttctggcgttatcctgaaaaagaggtggagaaaacatgaagagatttccggaaggttttttatggggcggcgcaacggctgccaatcagattgaaggagcttataaagaagggggcaaaggactttctacggcggatgtctccccggacggcattatgtctccgtttcatgagacggacgatgcgctgaatctgtatcatgacgcgattgatttttatcaccgctatcaagaggatatcgccctgtttgcggagatgggctttaaagcgttccggacctccattgcgtggacgagaatttttccgaacggcgatgaaacagaaccgaacgaagaagggctgcaattttacgaccgtttgtttgacgaattgagaaaacatcagatcgaaccggtcgtcacgatttctcattatgagatgccgctcggtcttgtgaaaaactatggcggctggagaaaccgccggacggtcgatttctatgagcggtacgcccggactgttttcacacgttataaagacaaggtgaaatattggatgaccttcaatgaaatcaacgttgttcttcatgctccgtttacaggcggcggtcttatattccgggaaggcgaaaataaacaaaacacgatgtaccaagcggcccatcatcaatttgtggcgagcgcgctggcggtaaaagccggccacgagatcatcccggattcccagatcggctgcatgatcgccgcgacgacgacgtatccgatgacgccgaagccggaggatgtatatgcggctttgcaaaaagagcggagcacgctgttcttttctgatgtgcaggcgaggggcagctatccgggctacatgaagcgcttctttaaagaaaacggaattacgatcgagatgaaggaaggagacgaggcgctcctgaaagaacatacggtggattacatcggcttcagctactacatgtcgatgacggccagcacggcgcctgaggatctggcgcaatctaagggaaatctcctcggcggcgtgaaaaacccgtacctgaaatcttccgaatggggctggcagattgatccgaagggcttgcgcatcaccttaaacaagctgtacgaccgttatcagaaaccgctcttcatcgtcgaaaacgggctcggcgcggttgatcagccggaggaggacggaaccattcaggatgattatcgaatcaattatctgcgtgatcatttaatagaggcaagagaggcgattgaagacggcgtcgacctgatcggctacacgtcgtgggggccgattgacctcgtcagcgcctcaacggcagaaatgaaaaaacgctacggctatatctatgtcgaccgcggcaatgacggaaaaggcacgtttgaaagaaagaaaaagaaaagtttttattggtataaaaacgtcatcgccacaaacggagaaagtctgtaagcgtaatgttccggagaaagccggcaaaattgacattcagcaaagagaggaggacaataaaagcagaaaggcgggattcatatgtttaaaaaaattcttgcagcagtagacggttcagacatgagcaataaagccctggacgcagcgatccatctggcgaaagaacagcaggctgaactcaccattctctatgcgggacgtgaagccgttgtctccacatcagccttaacagggattgtctatgttccggaaaacttcattgaagacattaaacatgaagtcgagcaaaaaggagcggccattctggaagatgccaagcagaaagcggctgaaagcggggtaaatgcggaaagcctatacgtccaaggcgaacctgcgcatcaaattttaaacatagcgaaagaacagcatttcaatctgattgtcgtcggaagccgcggaatcagcggatttaaagaaatgatgctcggaagcgtgagccataaggtctcacaattgtctccttgtcctgtactgatcgttcattaaacagaagaccctgctgatgcggggctttttttaatgagaaaagaccgccgtctttcgaaaaataggatgaaatcttcctctgaatcaagtaaaatggctgttagtatttgtctgaataaacagtcaatgatatgggggaagcgaatcaatgcaagctgaacaaacatcaaatgccgtcatcaaaatggtcatttccatggtcattttcggatcaatcggctttttctcggaacatacgaatgtgccttcaattgaactggtctttgtgagatgtctgtgcgcctcattgtttctgggcgtttgctggtttggttccggacggtatcgcaccgaacaatggaaccggcgtgaggtgctgcagacactggcctgcggattttttctcgtgctgaactgggtgtttttatttaaatcatttgaggagacatcagtgacgatagcgatttccgtttatcatctggctccggttcttgtccttctcctagggagccttatataccgggaaaaactgcatctcatatccgtcacttccatcgtgatttgctttctgggcaccgccctgatttccggcatcaacggaaatacatcattttctcagctgatgggatcgggtattatttgggccgtgctggccgcccttttttatgcttttacgacactggccgggaaaggtatcaacagtctcagcccatacgccgtcacctgtttgcagaccggattgggcgttatcattcttcttccgttcgtccgtttcggcgctttttctgatttgtcgcatgtgaattggatcatgattgtgtcaaccggtatcattcatacgggaattgtgtatttgctcttttttgacagcttgcggtttttatccacccggtttatttcaatcatcgtatttcttgatccggcggtggcgattgtgcttgacaccgtatttacgggatttcgccccgacctttatcaatctttggggattgtattgatttttgcgggaatggcgctgtccctgattcgaaagcaaaaagccgtgccgtcggaaactcaggcagacagcacccgtatataggcggccgtaccggctgctttttttattttggggctattcagccataacgaaaaagcagacaaacagatcatggaaaaaggggatagtaattgtataatacttcttgtgtttacaatttaagagattaaaggagtgaagggcatgataaacaagacgcgtcatctcgctttcttggctgcactcggctttgcgctttgtctggccatcgtatgttccgtatcaaagcaggcagaagcggcagcggcttatccggatgtgatgcagggacttaccggattcgcgggaaatgcgaaggatcataacggaaaagcaaaatccgccgtatcgggaggccagggcggccccgtcgtctacgtcagcaatctcaatgatttgaaaaacaatgcgggcggaacggatcgcaaaaccatcgtcatcacaagtgatatttcttccccgggtaaagccgttgtgacagtcggcgccaataaaaccatcgtcggctcttataccagccacaggctgaccaacatctatctgaccaccggctccggctcaaacaatgtgattttcaaaaatctcattatcagccatagtgccgccattacgggcaacaacgacattccgatgtacatagcgaacggacagaattactggattgaccacgtgtggtttgaaggacacagctacaatccgaacagccgcagcgatttgggaaagcttctgtatgtcggcgccaaagcggattttgtgacgctgtctaactctaaattcacagaccatctgtacggcctgattctcggttatccgaatgatgataacgaagggcgcaattatatcggctatccgcatatgacgatcaccaacaactattttaataacgtctatgtgcgttcaccgggcctgatgagatacggctattttcatgcgaaaaacaactatgtgaccaatttcaatttaggattcaccattcatacaaacgcgactgtcttctcagaagccaactatttcggcaacggaaatgaaaaaggcggaatgatagacgactacgggaccgcccaattcactgacaccggttcattcccgtcgctcaaagccccgaaatcaccgcgcaccggctggaatccgagatcaaattacagctatggcaccctttcagcccaggacgccaaaaacttcgcccaatcctacgcgggagcgcaaaatacaaatctccgctatccataatacgaaaaaccgccggcagccggcggtttttttatatgaataaaaggttcaaaattcctataatccttaaaataaccttaaatacctaggaaaatattgataaacaatttcaataatattactattgttaagcctaaattacaaaagaaggaggagaacctatgaaaataggaaaaaagaacaagtggaaaaagtggctggccggcactcttgcggcaacgctgatgatttccattgcgcctgccgatgtgtttgcggcagaaacgcgtgataaacaagttcaagcgaaaaccgccgccattccggccgcagacccggaaaaagatcttccggcggaaaaagcatctgagcagatgccttttgatcaaaaagatatcaatcaagacggtgagatcacgtctgaaagaactgagaattcaaagctttactatgaaggcgagggtgtgtacaaacaggaaatctacacagaccccattcatacgaaagaaaccgccaatgcggactgggaagacgtttctcctgaattgaaaaccggctcaaaggaagtcgggacggaaaatacagtgctgaactccgattttctgaagcaaatgaaaaacggattatacgctacatttgaacacgatgatcataagctcacatactcattaaccggcgcaaaaggccccgatcaggctgcaattactccgacagatgcctcagcaaaagtaagggaagacagcaacgagcttacgtatcagcaagtgtttcctgcaattgatttacaaacctacacatttaacgaaaacataaaagaagaccttgtgcttcacaaatatgaaggctacaattccttcacctttcaaatcaaaaccgacctgcaggctaaagaacaggaagacggctcgatcgcgttttctgatgataaagacaatgtcgtctacaccgtgccgaagccctttatgaccgactcagatctcgacgaaaagtcaggtgaagtcaacaggtcagaagatgtcagcttcaaacttgaaaaaaacagcgaaggctacttgctccatgtaacggccgatgaaaaatggctgaaagatcccaagcgggtttatccggtatctattgacccttcaacatcagtatctgtgtcatccgatacctttgtcatgagcgcgtacccgacgacaaactactctgccgcatcgcagaaatgggatgccggattgaaagcgtacgtgctgaaaactggatattatgacggttcaaccggaacgaactacgcttttatgaagtttgataatctaaagccgatcaaaaacatgacggtgacgaaagcgacgctcaaagcatacacagcccactcctattacggatcaaaggcgacggggctttggctcgacaccgttaacagcaattacgacaatgccaagattacgtggaagaacaagccgggctccaaaaacatcggcaaagccgaggtctataaaggccaatgggcaagcttcgatgtcacctccgcagtcaagtcgtggaatagcggcggcgccaattacggctttaagcttcacgcaaacggcaacggaaaagaatattggaagaaactgatgtcatcagcaaactctgctaaaaaaccatacattgaagtgacatacacgattccgaaggcggacacgccgtctgtcaaagcgtatcataacggagattcgacaggatttttcaatatcagctggaaaaaagctgaaggcgccaaaagctataaagtgtggctttataacgggaaagaatatcaagccattccggtcggcaatgcaacctcttggagcacaagaggaaaaaagatttggccgacaaaagcggaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccaaggagaaggcgccatgtctgcggccgccaagcccgtcattccgaatattggcagagttcagagaccgagcacgaaaggctttaataacaacaacgccacaggctggtttgatctttcctggaaagccgtatcaggcgctgccgggtataaaatgcaagtttataacggcaaaagctttgaaacgcttgacctcggaaataaaacatcctggtccacaaaaaatcaaaacatctggccgacaaaggcggaaatcagcgccggaaaatatgcgcttcacctgaaagacaaaaaaggcgcggaattgccaatcaacccgggctctgtttataaaaacgccggcggagatgcgaaccggaaaacctacggatttaaagtcattgcctataacaaagacggagaagcgatcgcctcaccggaagcgagtccggcgctgcctgatatcgcaaagccgaaaaacctgacaggctacgtctatacgaacacgaaatccagccaaacgggttatgtcaatctcatatgggataaggtgaaaaacgccaaaggctacaaaatcaacatctacaacggaaaagactatcaatcatacgatatcggtgataccgatcattggacgacccaaaacaaacacatctggccttcagccgatgaagtgaaagcgggaagattccagcttcacacggacggaaagggcggcgaactggcgcttgacccttcacctgtttacgaaaacgcaaacggcaattacaaagggaagaagaactattcctttacgctgaccgcctatgacgcaaacggtgacagcataccgacggcaccttttaaccctgttttccatgaaggggcggaattcctcggaacggaagaattctggtctattatcgacattccggacggacagctgaacggcgcaacgggaaatgtcatcgtcaatgaagaagatatgtcaatcgacggacgcggaccggggctcggactctcccggaccttcaacagccttgacagctctgaccatatgttcggccaaggctggtatgccgatgcggaaacgtcgattctttctgaagacggcagagccgtttatattgatgaggacgcgacaacacatgtcttcacgaaaaaatctgacggcacgtatcagccgccgacgggcgtttatctcgaactgacggaaacaagcgatcaatttgtattaaaaacaaaagatcagacgaacgcttatttcagcaaaaaaggcggcaagctccaaaaaatcgttgacggacacaacaacacaaccgtatacgagtataacgacagcaatcagctgaccgccataacagacgcatcagggcgcaagctgacatttacctatgatgaaaacggccatgtcacatctcttacagggccgaaaaacaaaaagatttcgtattcatatgacaaagaccttctcaaaaaggtgacggatactgacggcagcgtcacaagctatgactacgatgacgaggggcgcctcgtcaagcagtattccgcaaacagcacggatgacaaaccgctgttcactgaataccaatatagcggccaccgcctggccaaagccgtcaatgcgaaaaaagaaacgtacgactacagctatgacgcggacaaaaaaacgctgctcatgacgcagccgaacggccgccaagtgcagtacggctataatgaggcgggcaacccgattcagatgatcgatgatgccgaagggctgaaaatcacgaccaacactgtatacgaaggcaacaacgtcattcaggacaccgatccgaacgacgcggatacgggcaaagcgacagaaagctatcaatatgataaagacggcaacgtcacagccgtaaaagacaactacggcaccgaaacgtatcagtacaacaaaaacaatgacgtaacgaaaatgaaggacaccgaggggaacgtcactgatattgcgtacgacggactggatgccgtttctgagacggatcaaagcggaaaatcctcatccgccgccgtttatgacaagtatgggaatctcattcaatcaagcaaagagctggcagcttcggcaagcctgctgaaagacggcagctttgaaggaacaaagctgggctggaatctcaccgctacgagagacagcggaagtattgcatctgtaaaagcaagaagcggcgcgctgtccggacaaaaagcactggagatctcctcacaatccgcttcagccggaacagagcacggccatgcgtccgcaacgcaggaagtgcagcttgagccgaatacgacgtatacactcagcggccagatcaaaacggatctgacaaaggcaagagcgtatttcaacattgatctgcgtgacaaagaccaaaaacgcattcaatggattcacaatgaatcaggcgcattagccggaaagaatgactggacgaaacggcagatcacctttacaacaccggccaatgcaggaaaagccatcgtctatatggaagtggaccataacgacaaggacggcaaaggaaaagcgtggtttgatcaggttcagctggaaaaaggcgaagtctcttcaagctataacccggtgcaaaacagcagtttcacggctaaagcagacggctggagcacaagcggagccgccgctgaccttgatgaaggcttcgatgatgacagctcattaaaagcgtcccgcacaaatgcatcacaagccaatgcggccgcaaaacaaaccgttacattaggccaaagcgcggacgataagccggtatatatcacgctgacaggaatgtccaaggctgacggtgtaaaattaacgaacgacaatgattacgctcttcaggccggcgtcacttatgcggacggaacgacgggcgtctacaccgccaaattcccgcaggggacccaagaatggaaccgggcagcggcagtcattccgaaaacaaagccgatcaataaaatcgaaatcagcattctgttccaaaaaagcgccataggaacggcgtggtttgatgatatccgtttaatcgaaggaagcatcctgacgaaaaacacctatgacgaaaaaggaaactacgtcacaaaagaagaagacgaactaggttatgcaagcactgcttcatatgacgagactggcaagaaaacatctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggcacggaccagacctatcaatatgaatatgacgtcatgggcaagctcgtcaaaacaaccgacccgctcggcaatgtactgaagagtgaatatgacgccaacagtaacttgacgaaaaccgtttccgccaacggcaatgaagtgtcgctgacctatgacggcaccgatcgggttaagtcaaaagcgtataacggcactgaaaaatataactttacctatgacaaaaacggcaatgaaacgtctgtcacaaacaaagaacaaaatacaacgaaaaaacgcacctttgacaacaaaaaccgcctgaccgaattaaccgaccgcggcggcagccaaagctggacgtatccggctgattcggataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggcaatgaagtcggcacgagtttttcatatgatgagcggaatctcgtcagctctcttcatatcggaacgaaaaacggcggcagcatcttccgggaaagctatgaatatgacgccaacggcaaccgcacggtcatcgacagctcagcgggcggaaaggtgcagtacgaatacggcaagctcaaccagctcgtcaaagaaacacatgaagacggcaccgtcattcaatatacgtacgacggcttcggcaaccggacaaacgtcaccgccacaaaggacggcgcaagcaaatcagtcaacgcatccttcaacatcatgaaccagctgacgaaggtgaatgacgaagacctgtcctatgataaaaacggcaaccgcacatcggacggcaaatacacatatacgtgggacgcagaagacaacctgaccgccgtcacgaaaaaaggcgaagacaagccgttcgcaacatacaaatacgatgaaaaaggaaacagaatccaaaaaaccgtcaacggaaaagttacgaactacttctacgacggagacagcctgaacgtcctgtatgaaacagacgccgacaacaacgtcacaaaatcatacacgtacggtgagagcggccagctgttatcctatacagagaacggcaagaaatatttctatcactacaacgcacacggcgacgtcatcgccatctcagacagcaccggaaaaaccgttgccaaatatcagtacgatgcatggggaaatccgacaaaaaccgaagcaagcgacgaagtaaaagacaaccgctaccgctacgcaggctaccaatacgacgaagaaaccggcctgtactatctcatggcccgctactacgagccaagaaacggcgtattcttatcactagacccagacccgggcagtgatggggattcattggatcagaatggatatacttatggaaacaacaacccagtgatgaatgttgatccggacgggcattgggtgtggcttgtggtaaatgccggatttgcagcctatgatgggtataaggcatataaatcaggtaaagggtggaaaggtgctgcttgggcagctgcttctaactttgggcccgggaaagtgtttaaaggtgctaagaaggctttaggatttgcgaaggccgccaagaagtatttaaaacctggtaaatacgctagaaggtcaattcctgcaagaagtacaagtagcaggttaaataaaaaggaaagaagagtattaaacaaaattgggaataaatatggctgtcatacttgtggtagaaggcaccctggaactaaaagcagaaattggattgcagatcaccaaccagtatcaaaattaaggaagaaaggccagcgacaaaggctatatcctcattgtcaaacttgttcacgaaaacaaggaggatatactagtgctattctaagaaaaagacatcaacggaggtgaggctgttgggtggaaaaaaagaagccattctcgcattgcttaacgattcattcaataaggaagagtttccgtttcttgataatgagaattttgacttcgcaaaagggaagctttcgatttttattgaaagagataactggcttttaacgtttcagctgtttggattgtcgagattgggaccagctattgatttttatgcggtaggtaatcaattaacaaataatgaagtaagttttttagatgatgaaccgtttttatttgcagatgaaaaaggaaattttctggaattggaagatgtagaatcgggttttacaagtaaacaaatcaatgtgtctcttagagagaaaacatttcaattttttattgagcaggaaataaaagataagatttccccaaagaatgaatggattacatgtttgaggcatatgaccaaaaatagattatttcttgacacactttggctgacgaaacaagaacaactggaaatagcgggtctctcttcggagtatgaacaattatattcaacagaattatggatgcatccagaaggagaaaaagatttgcctagtttgtctcctttctttcaatcaattgccgaagcaatttcccgtcaagagatagcatatattcaaaaacatgctgatggtaacacagagtggccaaaatgggcacacgcagattctgttcaatacttttgaagatattatagacatgcagtaattggaaataatccgttatatattaaataaattattatgtggaagataaaatataaaaataatttaataaggagaatgaattttgattaaaagtaaagaaattcttagcctattagatgatgaatttagtgaattaaaccgaccaatttttgaatggcgtgaatctaattatgttgggagtaaatgtaccttattaagattaaatgatgacaattggttactggcaattcattgcttcgaagtagattctaaaggaccttttctggctattcatacctatagtaactgtttttcagacaactacaaatcgataataattgatgacttcgccttaaagactgaagcaggtgagaaaataacatatcgtgaaagtgattttcaacaattaagcgaagtagtggaaattgaaattaaagagtctcgttattgcgtaaatattcaccaaagaaatgaattccaaaagagtacaaaagaaagggcttggaaaacttatttcaggaatttgtttgaggatgcttcttttagagaggcgctttggataaagccaaacaaactattaaatatactggatctaaaaagcgaagcagaaggagtgttcgaaacagaggattgggaatatcctgattacctaacagatccaagccaattaatttcttttcaatcatttgcgcaatatcttgaaaaaggcgcaggttcagttgatctaggtgaagtaaataacaactggagggagtgggaggattacgatatagagtgagttgatgaaggaacccttttttaacctctgcgcttacagaattcaaacacgatattattcaggatatgagcggtatgaaatagaaaagaaagaaggccgttctattgggttattgggaagaagaatataaaaacaagaaagtgttattgagtgatgaaggcttagatatatgttttgatgcggtagaaaaattttgtgaacgatataagagggatctggatagagaaccgatattagaagaattcttagcaactttagttaccgttatgaatacaaatggagattcttctttcacggagttagttgataagcgaatagtagaaataaaggcaacgaccaggaaagcgaaatcaatagctaaagtagtaccgggagctgttattaaatacctttggataagatcgggaagtatacttatgcttgggttattgaaggtgatctatcaaaaaataaagacgatgacattcttattcagtactataatatttttactgaaaatactctgagaagaagttattcgtctaatgaaagaagaaaataagaaaatatttgcggcaaataccgggtatacaggttttcttcaaggggattggacagtaatatccaagatgcctcaagagataatagagaaaaacagtaattctcaactaaaatttgttttatatgaagacggtaaatatctcataagtgaaggcgattcatttgcatcagaagatgaattagcagaggcagatgagaaaacaggcaagaacatccctaacccattgggtatatttggacattcatctgtagaatctattctttataaatattttgaagggatgacaatggaggaaatcataaagtatgaattgtaaaagacagatttcttacattcgcttgtacagatactgacagtagtaaatgttctgagttctgaacgaggtgtaatatgaaaaaaatcaacctgaattctattacacagaaagagatcttacaaatagaaaaacaatttgaacgaatagcattaaataaaataagaaacaatcaagaaaagtttagaaaaatgggtttgaaaattgaagctgcttttggaagagtcggacacgaaaaagaaataggaaaagaagtacggccctcagattgttttgagagtacctataattcattgatatttttttctgcagcttatttggacggcaccgactttcacgataatgaagacggctattgtgtagaccacttagatatatgggtttgtgaaaaaaagttgttttcaggtaaagctggatatttatcagatctagaaagtgatgaagaaatcgcaaaagaaattcaaaacaagataaatgaattgtacttagaagcggcagaaatgattgaaatgttaaatgaatcctagtctattaatgtaagagaggttctcagcctctcttttcacccaaaacgaggaggcagcatggctaaaattagagatgattgtctggaacttgacataacaccgagaaggtatcaagaggcggaggatgatccttttatctcaacaatgtttgaactgttagaacataataaagtaatcgctcgcgattactccgccgctttattagaaagtgaatataaaatgctgatatcagggattgaagcattattagcagggaatcaagataggatacgtttagaaacaattgaaccattttttattttgagtattgataaagaaaacgaatattacagatttataattagatttgtggaaaatcattcaaatacaactttctataaattgaactgtaatgaagaaaagctagaatttttcgtgaagactttaaaatcagatctcaaagacacaaaaaatcctccaaaacgtccttaggagataaacaatgtacaaaacaataattgattgggttgattatatagatgaggggtgcgctgtccttcattttgattttaatgtgtttaaaaaagaactttcacttgatattaaggtttttgaaaaagaaagtgaatatacacataaaatattatttcaaaatgtagcatctgtttattttagcgcagatattggcgatatgagattagaaaaaatagatcccgaagaatacaattggcaagtatttgagatgagttatcatccggaaggaatcggaaatctatcaaattctgtaattccggagtatcaatcaaatgctaactttctcattgacatgaacagaatgctgattgctgtagaagctgaaaccgttcgctttgacgaccaatcattttatacgtatcgttcgaagtcataaataaacaaataagagaggttcccagcctctcttttcttaaaggacagaaaccaaaccgtggatctgcagcaaatacatttatacgttggaaaccgtttattccacacagaatatggctgtgagcttgcgtataaacccccgaaaataagaggtacaagatgcatcccttttttataaagaacacaaaggaatcggcagtctttcaatcccagatatattccttatttcatgaagacaaaacgttgcccgaacaagtatttaaacaacaaaaacattattatctattcgaggaattccactgggtcttgtctgaagaaggctggatgatgctcaaaagtttggcgcatcatcatcacgatgaatttatcttaatggccgttctggaacactcggatgatatgaatcggttttacgagaaattcggatattttaactggttaaagatccctttgcatataactgcagatgaatatctttcaatcttaactgattatccaaagcacagtaaaaatgactgtatattgaacattgcatctcgtgttgtttgggcttcaccgactttcaagtgggcgatttacggagagagagaatttgaaatttgtattttaggcattgatcaggagattgcgggaaaaacgttagaatcatggaggccgttagatgatcatgttttagactggatatcagttgtattcccggatcagatcgttccggatgaatttcaaaaaaagctcgccgcgcattataaatagcaaggggcaattacatgaaaataaaaatgaacaagatacacgatgaatcagtaaaaggatgtttttgtcactttgacaactgcggacgtcagtatcttggacggcatcagaatggcggtctctcgtttacaatcacggatgaatccggcgatacccgagtgattcatattgatgaacaaattccgtgtgaggatattatgctgtttcaacagagttcggctgacaggtatgtgctgattttctttgaatcgcatgagcataaagtgaaagtattttcagcagatggaacagaacaaagtgcattttctctgccttcaggggtttcatgcagtcttttggacgaaaaacaaaacctttggatcggtttaagtgatgaaggcatttatagcgatgaaaatcctgatggtcaaagtgtgctgtgcttcactttagacggacaattaaaggaaactcacattgatcagcagctttcagaaatatatgcgcccgttgtagatgactgctatgcgcttgcggaaaaaaacggactgatctacatgctgtattactcttatacagtcattgctgcgtttgatgagacggacgtgaaacgagtgtggattatttctgataaagcatgttcaggggtatatgatcagcttgcgatttcagatgacgggttttggatatgcaaagatgatcattcactgtccttcattccggctgatgtcagtctgccggtgcaagaggtaacgtgctgtgatccggatggccgtgagctttcggggcatcagctgaagctgacaagtaatgccatttacgcggtctcgacttcggggatctacaagcgggatataagtaatgggaaacaaaatgaattcttttcggctaaatgaaatgttgagatccaacagatattctttaaatgatgacctcatcagaaacctgaagtttcacaaaaaagaattgaagggtccgctgccctcagatgcggggagttttgaagaagactttgagggggttgcctgcgcgggggatttttatgaatatttcgcgcttgtctgcggcagcttagatgttgttttggcgaataaacaaatgcctaagtggcagcgtaaagccttatataaatccttttttgagctgtatcctcaatatgcgcatctggaaaacgctttaacagattacccggagctcagccgggacatcgggcggcacgaacgggccaggaggctgttagtcagcattttaaacaattcgaaaggcaggcttctaacatgaaagaacacaatggcagaatgtctgaagaaggctgatctgatcctgaacggtcaagcggcaagggaagaagtgtcggattgggcgtgtgagtacgtggctgcacatgatccggaggttgaggatgaaaacgtttgggagatgctcgtgtatttgagcgggtttgttctgaaagattcgcctgattcgtatctgcatacgattgaagaattaaaagattggatggcagaggtgaaacatttgaaaccgcgggaggcagaaatatatgaattggcattgtttgagtgaggaggagacagagcaattgtggcgcagggtgaatcgcgcagtgaaatggaaaccgtacagtagatttgcttcaataaaacctccgaagccgtttcaagtttttaatgtatctcaaggattcaatgatgaaaaagggaatatcagttttttggaagatgcagaggtgcagatactaaaggcatttcaatcttgtaccttaaagcaagagtttatatatgcgctggactggcagcatgaatgttatctatttaatcctcatgcgccaattgataaagatgaattcggcgaatggctggtccccgttatcccaaacggagactattgtttctttattcatcaggactttcagtgggggctgtcaggggatccgcggcagcaaaccattacggtttttggctcaccgctaataagggcgatagaaagaaacgctcctgtcttatttcaaaagtgaatgccgcttgcgaatgcatctcatgttttatgggggaggaataacgatgacagaagaagagttcagggctgcggaaaaaagcttgagagcgtcttttccgaaagcatataaacggctgcttcataaaaagaaccccgcggaaatcggggagtggatttttttccctatccgtgaacaaggccgtttacagaaaacctgggatgatgtgatcaggcaaaacagtgtgtgcagagaagaaagcatgcccgacgacatgattgtaattgccgacaacggaaccggggataagctgtgcttgaagaaagcggacggcgtaatggaggagaccgtttatctgtgggatcatgagactgccggcgttgaattgtatgccgctgctataggggaattaatagaaaatgaaaaagaataagtggctgattcatgagattttagaattccgcctcttccgggaaggggagatttctgtaattgagttggcgttttcctccgagtatgaacatcagctcattcatgtaaagctcacatgcaaagacgtttcttccgttcggataaaagaaatggagagtcatgcggctggttcaggcattgtaacaattgatcctgttgctgacggcgatgatggacggcactttctcatagaggagtgggaggatcaaacgttccgcttttactgccgtcaatatgaagcagcagaggagaaggaggcgcaaaatggagtggcacaaacatgagaaagcagttctgctggggccggattcgccgggttgttttgaattgacggagtttactttctataccgggtataacgagtattatgataaaatcccggtgtttgagctgaagctgactgacggacagtatgatgccgtgctgcggtttgaggatgtgaggtctgcccggctggatgatcttgaaagcatcaccgacatccatctggatatcagcccggtcgacggcggctgggaatcgatccgctactatgtcaatgacggggaaggaagcatgagcttttattgcgccaaatgggtcgtgctcgacatgaagaaaaagcagtcccccgaacggcccggcaaaacgtcagggtaaagcggcggcatttcgcgtataatgaggggagccggacagagaaggagtttagtcatgaatgagtttaatgaatatgcgatcagccccgagatccgacgggcgctgaatggcttgcaatacaccgagccgactgaagtgcagcggcgcgtcatccccgccgcgctgcaaaaaaaagacctcgtcgtcaaatcgcagacgggcagcggcaaaaccgcggctttcggcattccgatctgcgagcttgcggagtgggaggaaaacaaaccgcaggccctgattttaacgccgacccgcgagcttgcggcgcagattaaagaagatatcacgaatatcggccgtttcaaacggataaaagccacggcggttttcggaaaagcttcttttgacaaacagaaaaccgaactgaagcaaaaaagccacgtcgttgccggaacgccgggacgtgtgcttgatcacatagaaaaagggacgctgccgcttgagcggctggcgtatgtggtgattgacgaagcggatgaaatgctgaatatgggatttattgaacaggtggaagccatcattcagcatctgccgaaaaacagagtcaccatgctgttttcagcgacgctgccggatgacgtcgagaagctgagccgcacatatatgaaagaccctgaattgattgaagtaaaagcggaaggcctgacgacaaaagacatcgagcattttgtcaccagaacagaagaagaggacaaaacatctttgctgcgtgatgttctgatcaccgaaaacccggacagctgcatcatattctgccggacaaaagaaagggtcatccagttaaccgatgagctggacaggctgggctacccttgcgataaaattcacggcggtatggtgcaggaagaccgctttgacgtcatgaatgaattcaagcgcggcgagttccgctatctcattgcgaccgacgttgccgccagaggaattgatatcgaaaacatcaacctcgtcatcaattatgatattccgcttgaaaaagaaagctatgtgcaccgcacaggcagaacgggccgcgccggacaccgcggactggccgttacgtttgtgacgccgtctgaatcgcggtttctgaatgacattgagacatatatcggtttccgcatccaaaagcgggaggcgccgtctgagaaagaaacagcggaacggaaagcggcatttgcggaaaaattgaacgcccgccccgatgtcaaaacagacaaaagcgaacagttaaacaaagacatcatgaagctgtactttaacggcgggaaaaagaaaaaactcagagcggtcgattttgtcgggacgatcgcgaaaatcgacggcgtttcagccgatgatatcgggattatcacgattctggacaacgcatcgtacgtcgaaattctgaacggcaaaggcccgcacgttcttgacatcatgaaaaatacgacggtcaaaggcaaaaaactgaaagtccataaagccaagaaataaaaaaagaaagcctgccgcgtgcaggctttttttacgccgtttcctcaggcacaaacgcaaggatggcaatgccgattacaaataacaaaatcaggctgaacacggcggctgacgaatttccggtcagctgggcggtgacggcaatcaaaagcgggccgataatcgaagcgaacttgccgaagatattataaaagccgaaaaactcattggcgttctgtttggggacaagctttgcaaagtaagagcggctcagcgcctgaataccgccttgggaagtggcgacaagcatagccaaaacccagaaatcaaaagcggaatccataaaataagcatacgtgcagacaatcatatacacgccgatgccggcataaagcattgtttttcccttaaaccgttcggccagccgcccgtacaaaattgaaaaaggcgcggcgacgacctgtgtgacaaataaaacaatcagcagatttgccgcgctgatgccgaggtcagccccgtatgacgtggacatcgtaatgatggtgccgaccccgtcgatgtagaagaaataggcgagcagaaacaaaaacagcgcccggtgcttcctgatctgcttcagcgtgccggccagccgtataaaactgctgatcacaagccgcggctccctctcgatataatagcgctggcggacgcggagaaggagcgggatcgaaaacagcccccaccatgccgccgtaatcaaaaaggcaatgcggcccgcagtctgggcggacagcggaatcacctccgcttgtgctgacagaatcacggcaatgctgaggagaaaagggattgtactgccgatatagcccagcccaaaccccctggcggacaccatattcatccgctcctttgcggccacatcaacgagaaacgcatcataaaacacattagatccggcaaagccgatcgtggagatcgtataacaaattaataacagcatccaagattcgccgggaatcaaagccagcgcggcggtgcccgccacaccgatcagaaaaaagaaggcaaaaaaccgtttcttgcatcctttgtagtcggcaatcgttcctaagacggggctgagcatcgccaaaataaaagtcgcggcggcaatcgtatagcccaaataagcggtggaatcagctgcgctgacgccgttttccgccgccgccgctttaaaaaacaaggggaacaccgccgtcataataatgaccgaataagctgaattggcccaatcatacagcatccagctgctttcttctttcgaaaaccgtttcatcacacacgctccttcccaaaaaccggttctctgcattatatgcgcctctgcctcatcgttggacaaagatttctgaacggcgttttctgattgacatggagatattgacctagttcaaaaagaatgtacaatcaaggtgtagcaggtaaatggtcaggcgggagggagacagaattgaagattgcgaaagtcattaataataatgtcgtcagtatcctcaaagaaggcaatcaggaattggtcatcatgggccggggcattccattttagtttccttgtatttattttgtcttacattcacatatgacttggttaaggcaggcaaaacctaaattacaatgagcgctgatttctgtttgtgctgatggtaatttaggttttttaagattcattattatcattattctgaccgatgtccccttttaacagaatcatgtatgatcgataaagaaatcgctttcaaagaaaggggaatgccgacatgttttatcgtatgaaacgagtgctgctgcttcttgtcactggattgtttttgagtttgtgtgcgatcacttctactgcatcagctcaaacaggcggatcgttttttgaaccttttaacagctataactccggattatggcaaaaagcaaatggttactccaatggagatatgttcaactgcacatggcgtgcaaataatgtatccatgacgtcatcaggtgaaatgcgtttggcgctgacaagcccgtcttataacaagtttgactgcggggagaaccgctccgttcaaacctatggctatggactttatgaagtcagaatgaaaccggctaaaaacacagggatcgtttcatcgttcttcacttatacaggtccaacggatggcactccttgggatgagattgatatcgaatttttaggaaaagacacgacaaaggttcaatttaattattatacaaatggcgcgggaaaccatgagaaggttgcggatctcggatttgacgcggccaatgcctatcatacgtatgcgttcgattggcagccaaactctattaaatggtatgtcgatgggcaattaaaacatactgcgacaagccaaatcccgacaacaccgggaaagatcatgatgaacttgtggaatgggataggtgtcgatgactggctcggttcctacaatggtgtaaatccgctatacgctcattatgactgggtgcgctatacaaaaaaataatgtacagaaaaggatttccgccaacggaaatccttttttgattaaaacgaaataatcccaatcaaaagcgccgcaatcgtcatcacaatcgttgttcccacggcccatttaatagtgaatttttgatgatcgccaaagctgacgcctgccattccaaccaatagataggtggaaggcactagcgggctgagcagatgcacaggctgccccagcaaggaggcccttccgatttcagcggcgtctattccgtaagcggaagcggcttcggcgatgatgggaaggacaccgaagtaaaaggcgtcattcgacatgaaaaaggtgaatggcatgctgacgatcgcagtgatcaacggcaggtgcgggcccatggcatcagggatgagtgaaacgagagaatgcgccatggcatccaccatttttgtgccggagagaatgcctgtgaatatgcccgcagcaaacaccattgagacaacgtttaacgcattacccgcatgcgccgagattcgtttctgctgctctttgacatttggatagttaaccatcaaggcaacggcgaacgcagtcataaaaagaacaggaagcggcagcaggctggtgatcagtgcggccatcagagcgacagtcagcagcaggttaaaccattgaagagcggggcgcttgagcggtgcggcctccggatcggaagacggtgcgtgatcaatcgaaatgacgccgagccgcttccgctctttctttccgaggatataagcaacggcgatcacccagagaatgccggcgatcatagcgggaatcagcggcgtgaagacctctgacgtgtccaattttaaggaggccaaaaccctcgcagtcgggccgccccacgggataatattcataacccccgaaccgagcatcgctattcccgctaacaccaaacggttcatgccgagccgtttgtagagaggcagcatcgctgcaatggtaatcatataggttgttgtcccatctccgtccagcgaaatggtcatggtcagaaccgctgtgcctacggcgatttttaacggatctcctttgacaaacgataagattttggcaatgagaggatcaaacaggcccgagtcaatcataatgccgaaatacaggatggcgaataacagcatgataccggtaggggcgaggtctgtaacgccctgaatcatcatctcgccgagatctttgccaaatccgctgatcagggcgaacacaataggaacgacaatcaaagcaataagagcggaaagccggttagacataataaggtacataaagacaatcatcatcacaaaaccgagtatggcaagcatgatatgacctcccctattcaacagcttttttggtaagcgcttccatcctttctttctgtgaagaaggcttatttcaaatgtgtatgaccgcatatctatatgtagaccaaaaatcctaatgagcggattagcagtttatatgaagaacgccacgggtaaatgtgctgtagaatgtttcgttttaaaaagggggagcagacatgtgtgaagaccaaaacaaacgtgtaaatgaacactcaaaggacgagcagcttgagcagtacagggccgataacagcgggaagaaaatgacgacaaaccaaggcttgcgggtgtcagaggatgagcattcgttaaaagccggggttcgcggcccgacgctgatggaggattttcacttccgggagaaaatgacgcactttgaccacgagcggattccggaacgagtcgttcatgcacgcgggtacggcgttcatgggcattttcaggtgtacgaaccgatgacggaatatacacgggcgaaatttttgcaggacccgtctgtcaaaacacctgttttcgtccgtttctcaacagtggcgggctccaaggggtcagccgacaccgtccgtgacgccaggggatttgcgacgaagttttatactgaagaagggaactatgacctcgtcggaaacaatattccggtgttcttcattcaggacgcgatcaaattcccggatctcgttcacgccataaaaccggaaccgcacaatgaaatgccgcaggctgcgacggctcatgatacgttctgggattttgtcgcaaacaatcctgaatccgcgcacatggtcatgtggacgatgtctgaccgcggcatcccgcgaagctatcggatgatggagggcttcggcgtgcatacgttccgtttcgtcaacgagaaaggaaaagcgcgctttgtcaaattccactggaaacccgtgctcggcgttcattccctcgtatgggatgaagcgcagaaaattgccgggaaagatcccgatttcaaccgccgcgacctgtgggaaacgattgaaaacggcggcaaagtcgagtatgagctcggtgttcagatgattgacgaagaagatgaatttaagtttgatttcgatatccttgatccgacgaagctgtggccggaggagttggttcccgtcaagctgatcggaaaaatgaccctcgaccgcaatcaggacaatgtctttgcggaaacggaacaggtcgcctttcacccgggaaatgtcgtgccgggcattgatttcaccaatgatccgcttcttcaaggtcggcttttctcttatacagatacacagctcatccgtcttggcgggccgaattttcacgagattccgatcaaccggccggtctgcccgttccataacaaccaatacgacggctaccaccggatgacgattaataagggtcccgtcgcctatcataaaaattccctgcagaacaatgatccgtcgccggcctcagaagaagaaggcggatacgttcattaccaggaaaaagtagaaggcagaaaaatccgccagcgcagtgagagcttcaatgactatttttctcaggccaagatgttctggaacagcatgtctcccgctgagaaagaacatatcatctccgcgttctgttttgaagtcggaaaagtgaacagcaaggatgtgcagcagcaggtggttgatgtcttcagtcacgtcgacgccgggctagccgagcgtgttgcgaaaggaatcggcgtgaacccgccgccgaaggaccgtgaatctgatgaaacgttcacttccccggccttaagccaggaaaacacggtgaagacggcagcgacaaggcaggttgcggttttaaccgaccacgggttttctgatgagaaagtcaaacaagtgcttgatgcatgcaaacaggcgggagtcagagccgatatcatcagccccgcgctgggaaccgtcaagggagaaaacggcacggagctcgaagcgtcagccactttcctgacagcggattccgtcctgtacgacgctgttttcattccgggcggaaaacaaagcacagacagcctcaaagcccaaaaatcggccagagacttcgtcagcgaagccttcagccattacaaagcgatcggcgcctccggtgaaggaaaagaacttctcgccctcgccgccggaaccgaaaacggcccaggccttgttccggacggaaaccatgaacaatttctgaaggccgtggctgagcatcggcattgggacagaagcatataagaatgaaaaagcgccttttatgagaggggcgcttttttattgtgaaagtgaaatatctgaacgaagcattaatattgggagaaaacgaaaatggcttccgtgcaaatccgtcccttccgctgtccgggacattcagacaacagtttttagagagtcagggcatgcgctatttaaagcagtcgggttgatgaaataatatgtttcaccctctttggtttacttccgctctgtgtttgtgtatcttaggggtagattttctggaggagcgaatgatagtgaagccgtttaccgaaaaacaactcgaagaatattaccggcgtgacgaaaacatgatgattttggtgtttgcccaatggtgcgtcaatcatgaccttgatccgatggccatttacagcaaggcttatcccggacagcctttaaacgaagagctgcgaaaaacggctgaagaacttgtcgtgccgaaggaggaatcagaacggattcctgatcaaaccgttatcggcgttttggagatgttcggcaactccgatttggcggaagccgtttatgaagccattgcgcaaagaccttcacggtaaaagaggcgtggattttccatgtctctttttttatggagaaaatgtgaaagaaggcccagaaacaatttgctgatctgcgctgtctatagagtgtaaaccgttttcaaaaagggaacggtaatgaaaaggaggagttgtgatgaaaaaggcattcaaaatgatggcggccgtgctcttaacagtgctgacagccgcgccgttcggaggtttcgcgccttcagccgaggccgcgcaaaccgcaaagcccgtcgtcaaaagccagacgtataagcatgtaaagcagctgacataccccgaggtcacaaatacgggaaacgcatcttttgaaaagaaaatcaatcaggacttcaagcgctatattgaacaatcgtacaaagaatatgtgaaaaacaaaaaagacggtgagaaacaaggctacaaagcggaataccaggcagatttcaaggtgaagtataatcaagacggcaagctcagcattcagacggaagactacagttacacaggcggcgcacacgggctgacatccgttcagacctttaattacgacttggccgcaaaaaaacgggtcacactcgataatgtgctgaatacaaaaacgaaagctaacaagacgagagactatctttacggttacatcaagaaacatgatgatctgttcgatcaggacgttaaaaaacaggagatcatcctgaataacgaaagacctttcttctttacgaaaaacggcattgccgttgtgttcggacaatatgatctcggaccgtacgcggcaggaatccgggacgttttcgtacctgcatccgtctatcaataaaaaaaagcgatatcactccaaaacggagcggtatcgctttttttctattaccagacaaacaatccgacaatcgccgcgctcaataaggaaacggcaattccgctgacaagcagcttccagacgttttttccgatgatggctgatttttcaccatcaagcagagattgataagatccgtagatcataccgatggtgctgaagtttgcgaatgatgtcaggaatgtcgtagccacggcaatcgtgtgcggcggaagtgaattcagctgccctttcagatcggccattgccacaaattcattcgtcgcgagcttgatgcccatcagctgtgcgacatacatcgcgtcatgtccgcctaatccgagaaggaaggcaaacggactgaagatgtatgagaaaatcttttgaatggtcaaaccgtgcatgaacaatccgagtacgccgtttaacgcggccgttaacgccacatatccgatcaccatcgctaaaatgacaatgaccatgttcatgccgacaagcatactgttagagattgtggagaagaagtcttttttctccgcttttgaaggaacgtaaataatatcatcctctttagaaacgtccacgggattcagcatattggcgattaaaagggcgtttaagcaattcagcgggatggctgtaaacacataagtggacggaaccatcgtcaagtacgatccgatgatcgagccgctgatgctgctcatgctcatcagcccgaatgtcagaagccgattgttgctgacggcggcaagctgctggcggatgacggctaaagcttccgtatttcctaaaaacatcatctggatggagaaaaagctctccagcttcggcagacgggatattttagaaatcagccagccgattttatcaatgagccacggcagaataccgaaatacgacagcatatcaaagaaggtcacgacgaagataatcggcagcaatgcgctgaagaaaaaatcaaccgtcggattggccatgacagacggaaaagcgaacgcaattccttgactggcgcaggaaatcagccatgtaaagaacgcgccgatcttcccgatgacaaagccgccgacttttgtccctaacataaaccaagtaatcagaaactcaaagacgaggagcatgacaatcggacgccatttaatcttcttcttgttgggagagcataagaaaacaacagccatgacaacaatgagaccgacaatgttcaataaaaagtacatgtgagcaactcctataagggtattatggaaataaaaaaagctcttattcgtcacaaattcctgaaagccagaaagtgtgataaataagagccaaaagaaaagaatagacagcgtcatatgcttttcactcgttcaaatttatgcaaactttcttgtagtctagtcttttacggcactaggtagaaacaatcagaccatattactgatcatatacaagaataacgatattacatgagatagcagtattttatcgtttcaatttttgaaaatcaacctttttagatattttcaaaataataaatttatattataaataaagaaaataaaggatgttcataagtaattggataataaaggtttaaaatacccccaaaaaccgttccggttcattgtaaagacgggatgcagctgataaaatggatctgagggcacagccttcaaaagacggcagaaaaggggtcattttcgtgatcattcagttcattcgttacagataatgagaggtatagataaataggttaaaccttccaatttggcgaggtttatttgtctatgcctttttcatttcatcggaataacgaatgaatgaggtgtttttttgacgtctataaaaagaaaacgcgcggaattactgcaatcatgccagtccgtgttcaggtgtccgctatgccggtcggccatggcggtctcacaatacaaaagcttgatttgcggacaggggcatacatttgatatatcaaaacaaggatatgtgaatttcctcaataaatcggtcaaaacccgctatgacaggcagctgttcgaagcgagacgcgagctttttgacagccgggaattttttgggccggttcaaaaggagatcgccgccgtcatcagccgtaagcaatctccgcataaaccggcggcgatattggatgcgggatgcggagaaggctctcatttagccgccgtatgcaaattgcttcagcccgctttttccgtgacgggaatcggcattgatctctcgaaagaaggtgtgctgcatgccgcaaaggccttcgggaatcatttggtttttgccgtcgctgatgtggcggatgcgccgtttgccgacagctgttttgatgtcgtgatgtctgttttatcaccttggaattacaaggaatgcagcaggcttttacgaaagggcggcacagtcattaaagcggtgccgcggcgtgattatttgaaggaagtaagggaattcttcttcggagacagccctcggcggaatgacaccgccgattctgcggccggacgattccaagcgggctttcaaacctttgagcgcaaacggctgtgttacacgaagaccttagcgcagcctgacctcgagcggcttgtgaaaatgacgcccttaacatggaaatgtactgatgacagcatccggcggttcatcagccggaaagaggctgctgtcacgatagatatcgatattttaatcggaaccggtccgctgtaaaacggaaaagacacgctaatcgcgtgtcttttttttatttccagacttcaccggcaatgttgacgacatggcgcagttttgcccattgctgttcttctgtgatcaggtttccttcctcagtggaggcgaatccgcattgcgggctgaggcaaagctgatccaggctgacatattgtgaagcttcttcaatccggcgtttaatcgcgtccttgtcttcaagttcgccatgtttcgacgtaatcaatccaagcacaagctgaagatcagagcgtttgacatagcggagcggttcaaagccgccggagcgggaatcatcatattccaggaacaatccgtcaaggtcaagcccgtcaaaaatcgtttcagccgctgcatcatagccgccttcagccgtccatgtggattggaagttgccgcggcagatatgcatcgtaaccttcagatcgtcagggcggtccttgatggcgtcattaatggaagcggcaaacagcttgcgcagctcatccggcgttgtgccgaaagcttcaatctgacgaagccccgcttctgataagaaaacggcccatgcggtgtcatcgagctgaaggtagcggcacccggcgtcatagaaagcttgaatcgcttttttatacgcctttgacacatcgtgctgaaattgtttgtaatcattctggtaggacgctttttccaattttccgcggaaaaacagcatattcggacttgggatggtcattttcggaacagcatcgccggcaatgctgtgcaggaatttataatcttcgagcatcggatgctgagaaaaatcaatatctcccgttactttaatgccgcgcgctttcgtctgtacgttgtgaaactgaatgccgctttcaggcgtaaacgcttcgacgccgtctaaattttcgagaaaatcaaaatgccaccaggcacggcggaattcgccgtcagtcacgacattgaggccggtttctttctgcttttccacactgcggatgatttctctgttttcgatttcgcgcagctgttctgccgaaatctcacccgccgctctttgcaggcgggcttgcttcacagccgtcggccgcagcaggcttccgacctgatccgcgcgaaacggcgggttttttcttagaagcgtatgcaatggttgttctgtgttttgctgtgacatgaacgattccttctttcctgatgaaatataaaaagctcttccctcggatagggaagagcttgcgtccgcaaatctcaaccttatcttcaggatttagcaccattctgctgaacagcggttgccgggtatcatagggccagtccctccacctctcttgataaggaaatatgctatttttcagaataaactgtaatactcttaatcttagtatgttttctcatattgtcaatatatttcgataaatattttatttatcaccctcaaatagaatcatatctatcacaatggcgatcgcgagacaaagaacgatatcctcttccttttcaatctgcaaatgataggaatcgccccagctcatccatgatttggtgacggtcatccggtttgattttccgtctgtcacttgaaaattccggccccacacatcgccggtaagatcccagccgagtccggaaatttcaaatttcggtttgaaaaacgtgactttcttgatgacttggcagacgggtttgccgctgacggaaatctcgtaacggggaacgagcgacatcagtttctgattgacgctggcgagcgtgcggccgtccaaatcagtcagcttcagttcatcaccgaatgaaaacagctttccttcaacattgtagacttcttttccgctttcaagaaacacttgaaaacgattcttaaacgtcaacatccgctctttgatataaaaatggtacataaaaaaactccttttttatgttgtacgaaaaaaggaggcggatggtttcatatcggccgggtgcataaaaaaaaggctgccgattttgcggcagctgtcgtttttatgatagcggcatccggcgtttttgacggatcgcatttaaatcaatgatgttattcgtgtcggcagctgtcaccagcgggcttgtctttggcgttttccggcggttgtccttactgaaagagaaaacaagataccctgtcaaagcagcgaaaataagtagcatcattttacatacctcccaaaaaaagttttggtattattattgtacgaaaaaacaaacgaaaagtattcaaacaattgtcacttttttaaaaaataacgtcattttccgtaaaaatgactatgggttgaagaaattttgctcttgttgtggttctatagattgtatcggctgatggatgatcatcgtttatataactttttcactattttttgtaagtgtctaattaactacttcagtgttttcgtttgccttgtgttattcagtaccctaaaaaaccgtatgatatgcaaaataactgcttctaacagatgactgcgagttgacagcgctttctttatttttttaacgaaaacgagatgttatcttaaaaaaatcgtttgaacattttccgcagttttttaaaaggatttgatttcgtctccagaacacgcgggtcttttaaggtttttttcaattctttcgctacagtccctcttgccatagtcttcactccttctttccatttcataccttatatacggaaagaaagaaggaaaggtttcatgtgaaagaaaaaaaccaaagcagggggctttggttttaagcgcgctcttcaaagagcctggcgatttcaacaatgacgtttaccgccttttccatatgatcgacggaaatgtattcatattttccgtggaagttttggccgcccgtgaaaacgttcggtgtcggcagtcccatgtaagagagctgtgagccgtcggttccgccccggatcggttcgataatcggttcgatgtcgaggtttttcatggcctgataggcgacatcgactatctctttgaccggttcgattttttctctcatgttgtaatattgatcacgcagttcaagcttgatgctttccttgccgtatttagccgccagcgcatcggcggttttctgcatatattcttttcgttctgcaaagcggtctctgtcaaagtctctgatgatgtacgacagggcggcttcagaaacgtctccgttcatggaaagtaaatgatagaagccttcatacccttccgtatattccggcgcttcttctttcggcagtgcgtgatgaaattccatcgcgatttttgaagcgttgatcattttgtttttcgccgtccccgggtggacgctttttccgtaacaagtaagctttgcggcggctgcgttaaagctttcatattgcagttcgccgagggggcctccgtctatcgtgtaggcgaatgcggcgttgaagcggccgacatcgaatttgtgagggcctctgccgatttcttcatcgggcgtgaacgcgacccggatcgttccgtgtttgatgtccggatgtttgatcaagtacgccattgccgtcatgatttcggcaatgcccgctttgttgtcggctccgagcagcgtcgtgccgtctgttgtaatcagcgtctggcctttatagcgggaaagctccgggaattgctcaggcgacagaacgacattgagtttgtcattcaaaacgatatcatgtccgtcgtagctctcaataatctgaggattcacattttttccggtaaaatcggtcgcggtgtccacgtgagccagaaaaccgacagtcggcacgtctttatccgtattcgccggcagagtcgccatgacgtacccattgtcatcgactgtgatgtctgtcatgccgatcgactttaattcatctgccagcatgttggccaatgtcagctggccgggggttgaagggcagttttcattgttttcgtcagactgtgtattgacttttacgtaagaggtaaagcgttcaatgatttcatttttcataccgtcatctcctttgtcttatcttaccatgcgcgggggagggatttctatttcacaacccgtttgaatcgagggctctgttttttacgcgaatgaaaataaattatgaagaaacgatgactaaacgattaaactttttggaaatggatgattgaggaagaaaaaaccgatataatatggtcaattcattcaataggggaggctttcttcatggcgattttagtgacaggcggagcgggttatatcggcagccacacatgtgtcgagctgttaaacggcggctatgacatcgtggttctggataatctgtcaaacagttcaccggaagcattggagcgtgtgaaagacattaccggaaaagggcttgtgttttatgaagcggatctccttgaccgtgacgccgttcaccgggtgtttgctgaaaatgagattgaagccgtcattcattttgcgggattaaaagccgtcggtgagtctgtggctgttccgctccgttattatcataataatctgacgggaacgtttattttatgtgaagccatgcaggcacacggtgtgaaaaaaatcgtcttcagttcttcagcgacggtttacggcgttccggaaacaacgccgatcactgaggattttcctttaagcgccaccaatccttacgggcagacaaagctgatgctggaacagattttacgcgatctgcataatgcggactctgaatggagcattgcgctgctccgctactttaatccgttcggcgcgcacccgagcggccggatcggagaagacccgaacggcatcccgaataatttaatgccgtacgtcgcacaagtcgctgtcggcaagcttgagcgattgcaggtgttcggcaatgattatccgacaaaggatggcaccggcgtgcgggattacatccatgtcgttgaccttgccgagggccatgtcagagcgctcgaaaaggtgctgaacacaacgggcgccgacgcctataatctcggcacgggaagaggctacagcgttctggagatggtcaaggcgtttgaaaaagtatcgggaaaagaagtgccgtaccgttttgccgaccggcgcccgggagacatcgccgcatgcttcgcagacccggcaaaagcgaaggctgaattaggctgggaagcaaagcgcgggcttgaagaaatgtgcgccgactcttggaagtggcagtcctccaatgtgaacgggtaccaaaaggtgtaaaaagaaagagaccttcaaatggtgaaggtctcttttattacggtcattatttaattttcacttcaacatcgttgctgaactttaatttccaagtgcctttagagtatgcgtttttatcaacttcaaaagcttttacgtcagtaactttaatgttcgggttcaagtcacttaaaattttactgttgtctacttttgtttctgttgcatagcttgaagaagcatcaatatctgaatcataggatgttcctttagaatctactaatttcgctcttggaatggagaaagagcttaacggcttgtttgaaacatttttaactgtgtattgaacagctacgataacgccgccgtcagacgcttttttctcgacaaattgagagcctactgaatctcttttttccactttggtaacagtaacttcagttttctcagtcttaacagtgtcaccgatgttatacagtttttccttggattccgcagcttttgaagacgcggttttagatgatgaagatccgcctccgccgccgatgtttacgagaatgataataaccactactgccagaagcaatgtgataattttatgtctcataaaaaagtttctctgatctttaccgcagtttgggcattttttaacgcctttagcgatttctttgccgcatgccttacaagacaccaggttgcctgccataatatttcctcctatgtaaactatttcttaaaaactacatactataatgcctgtaaaataacctatagtcaataatattttgagaaaaaagtattttaatggttttttagtcatgtattttaagggtcttttttagtatcggcagatcgttcggattttttatagatttattgaaaaaagagtggttgaacatgttcgtgatttcccgtataatcttgaaagatatacaaaaactgaacataaaaaacagtggttttctagggttccgcaatgctgaattggtctggaccgagagaaaacacacagcaggttcctgctgtgacacgttgggataaaagcccgggagtttctgctcttttgatgaagagtgctctcccgggcttttttgattttataaaaaaggagtgtctgggatgaaaaagagattgctggatgtgctgatgctgattattggagcttttatctttgctttggccgttaatttattcgccattccgaatgatcttggagagggcggggtaacaggaatcaccctgatcttgtactatgtgtttgaatggtcgcccggggtgacgaatatcattttgaacgggattttattgatgatcggatataaatttttagacggaaaaacaacgctttatacgatcattaccgttgttgccaactcactgtttctgcatctgacgcatgattggcactcgccttcacatgaactcattattaatactatttttgcgggtgtgtttgccggtgtcggaatcgggatcattattcgagtcggaggcacgactgcgggttctgccattttggcgaggattgcgaacaaatatctcgattggaacatcagctatgcgcttttgttctttgatctgattgtcgtcttcagttcttatttcatcatcggtgcggaaaaaatgatgtttaccattgtcatgctgtacatcggaacgaaggtgatggactttatcattgaaggcctgaatacgaaaaaagcggtgacgattatatctgagcataagcacgaaatcgccgaacaggtcaacacgctgatggacagaggggttacgctgctgtcgggtaaaggaaattacacggggcagtcgaaggaaattttatatatcgtcatccagaaacaagagctttccatgctcaaaaaaatcattaaaagctgtgatacaaaagcgtttgtcattgttcatgatgtgcgtgacgtctttggtgaaggcttcgtcgatatctctaaataaaaaggatccctctgccggcgcggaggttttttttcttatgccggcagaagcggttatgattcgtttcccgggaaatagcctgaaagctgtttcttaaaacgaagtggatacaatcggccggacgttttatactgaaaatatgatagagcgatagaaaggagcgcatatgaacccgttattggcaatttacccgagggctgtgttgtctgatacgtgctgtacggcggaggatgtcttttgcttttatgatgagaaaaggcgggtctatgtcgccattccgaaggaggatattgccccgaaggagaaactgcttctggaatcatttttgacgcccgctgaagaaaaaggcgttttttttccggagacggcggcagcaaagaggtggcggcgttttctgctggaagaaggtccggtgcctgatgtcaaggagccgcgtgtccgttttatccattatgacttattgggagaacgggactggggggcatatacggaagcgctgcgccatttctggccggtttcatatacagttgtccggacggggagggatcatggcgtgattgtggaggaagaaaagctggaagcgccagattcggatgacatcgcatcttttgtgaagattctcgaaggcgatttttatttcagtgtccgttttttcatcggaaggtattactgcaagggggaacgtctgcgccttcattatcagagagaacagcaatattgtcagatcggccggcgtcatctcccgcagctgagcacgctgaccgcggaaacggtatttccggccatgctcacggaggaaagcagagaaaagctctcagccttgcttcacgaagaagcggcgctgctgtttcagaaagaaccggagctgaagcatacgattcagacttttattgaacataactcgaacatgtcgctcacatcgaaaaaactgcatttgcaccgcaacagtcttcaatatcggattgataaatttgcggaacgctcaggtattgatattaagacatatcggggcgccctgctggcttatttcatttgtctgcagtatgaaaaatcacattaaatgggaaatgtgcacgaaggcagcggactttttttatgaacattgcctatatccgccgccgtctgacgctgttacaatcctatttaagaaagcgtttacaaatagagggggatatatatggcggaacttcggctggagcatatttataagtattacgatcaaaaagaagcggctgtcgatgattttaaccttcatattaaagataaagagtttatcgtgtttgtcggtccgtcgggttgcggcaagtcgacaactttgcggatggtagccgggctggaagacattacgaagggcgatttctatatcggtgacacgagagtgaatgacatcgctcctaaagacagggatatcgccatggtgtttcaaaactatgcgttatatccgcacatgacggtctatgataatatcgctttcggtctgaagctgaggaaaatgccgaaaccggagattaaaaaacgggtcgaagaagcggcgaaaatgctggggctcacagagtatctgcaccgcaaaccgaaggcgctctccggcgggcagcggcagcgggttgcattagggcgggcgattgtcagggacgccaaagtgtttttaatggatgagccgctgtcaaatctggacgcaaagcttcgggtgcagatgcgggcagaaattattaagctccaccaaaggctgcaaacaaccacaatctatgtgacgcacgaccaaacagaagcactgacgatggcgacacgcatcgtagtcatgaaggacggaaaaattcagcagatcggcaccccgaaagaagtgtatgaacatcccgaaaacgtatttgtcggcgggtttatcggctccccggcgatgaactttttcaaaggaaagctgacggacggcgccattcagatcggttcagccgctctcagcgtgccggaagggaaaatgaaaatgctccgggaaaaagggtatgccggcaaagatatcatcttcggcatccgcccggaagacatacatgacgagctgattgtggtagaatcttataagaattcatccatcacagctaaaatcaatgtcgcggaattgctcgggtcagaaattatggtttattcccggatcggggatcaggattttatcgcccggattgacgcccgccatgacattcgtgccggtgaggaattgaccgtcgctttcgacatgaataaggctcacttttttgacagtgaaacagaaatcagaatccgctcataacgcaaagccggacagctggatgtccggcttttttgatgtaacaatttatgacgcataaccgatataaaaagtaaatagaagacagaaagcaggaaaacgatgaaacgcatgatcatgtgcatgtgccttttggctgccgtgtttacgcttgccgcctgctcgggtcatgaggcaagcgccgaacaaagcattccgaaggcagaagcgcacagcgaaaaaaagtccgtaaagcggcaaatcaaaaaagagccggatacgtccgcctgggttcaaacgaaaggaacggcgagactgccgattctgatgtatcacagcatttcagagggaaacagcctgcgtgtgccgaaggaagaattccggcagcatatgaagtggcttcatgatcacggctattatacgatgactcctgaagaggcctatctgatgctgacggaggataaggagccgcgtgaaaaatgtgttctgatcacatttgatgacggctatacagacaatgtgaaagcagcctatcccattttaaagaaatacaagatgaaagcgacaatctttatgatcggaaactttatcgggcataagaatcatctgactgagaagcagatgaaggagatggccgcccacggcatttccattcagagccatacgatgaaccatctcgaattgaacgggctcacaccgcagcagcagcgacgtgaaatgaaggactctaagcgtttatttgatcaaatgttcgggcagcggacgactatgatcagctaccctgtcggacgatataataaagaaacattaaaagccgccgcctcgtcaggctaccgtatggcggtcacgacagagccgggagcggcgtctagagatcaggggctttacgggcttcaccgcgtccgtgtgtcgccgggcatgtccggcgcggcattcggctcttatattcaaaatgtgatgaaataacagagcctccgcatcatgcggaggctttttttcagtttaatagaattgatgaagcagcagaagggtgacgctcacggtaatcgctccgccgattctggtcgacacttgggcgaacggcataagctcaagccgttcagcggcgctcaagatcgcgacgtcgccggtgccgccctggccggaatggcaggcattaataaccgccgtctcaatcgggtacagattcagccattttccggtcagaaaaccgacggccatcatcgtgacgacgattgataaaatggtaatgatgttgctgatcgtaaacgccgcaatcagtttgtcccacggtgtcattgaaacgccgatcgcaaataagagcggataggtcacggctgtcgagaaaaagcgcgagacgccgaaggctccgttttcaatcgaagccggcgccagcctgaacagcttaatgagaacggcaaggacgagcatcacgactggagccggaagctgaaagaaatcatgcgccagcatgccgaccaaataaagggaaaccgctaaaataccgcccgaagcgaaaaaggacaaatcaaacgttttatcatcggccggctgttccaatgcgggagcggaatgatcagacttatcaaccttcccgttgcccgtccattccggtttgcgtttcccgatgacattcagcaaacccgataacataatggcgcacaggctgccgagcatgatggacggcagcacaagcgcaaaggcgtctccctgggacatcggcataatatcggagtagccgatggataaaggaatcgcgccttcaccgacaccccccgccataatcggaacgacgatataaagcagcgtgtgctgaaagccgagcccgagcagcgtcccgacgcataagccgacgatggcggccgcgatagacccggcgatcagcggaataaaaatcttaacgaaagctttgacgagcgtctctcttttcatcccgagaatactgccgacgacgataccggcaataaatagatagagaaagttggagctttctgtgaattctgttgttgaagtaataatgtctttcggaagcaggtggtagtagacgacagcggatggaataaaggttgcgagaatcgcagggccgccgatggaccgcacgatcggaatggattttccgatctggccgaaggtaaatccgaaaaaactcatgacggcaattgatgtcagaatgtcgctttttacatcacggctcatgacaaacaccgtaataagcaagaaaagcaggatatagataggaagaggaataatgccgattcttatattcattgctctggcaaaccagttatcagtccgttcctgtttttggattgaatccgtttgcaattttggttgaagttctcccatgcttgttcccccagtcgttatgtagtgaaaaaatatccccatttaaagtatactaaagaatttaaattgttgatatattatgaatttactagaggacatgctttcttcacattttctttctcaaaatggcgatttggcgggctttttcaccgagaaaagcattttgttcgccacacgaataaaaaagaggtacgatatcaaagggacaaatatcctagtcgctgacataaaatctctacaaatccgacaataatcggtcacaatttcagcctgattttaggtatattgatctttttttttaggctgaatcgttgtaaagtaatgatattgaatcatttctatgacagccgctgtcccccagggtgtacaggctgatatttcaatagttttgacgaatttgtgaaacattgagcaaatatatcattttttgtgaaataccgagcaatgatctcgttatgtttgtgaaatgttgagcaatttaccagattggaggaaaaacatcatgagtgagttggtattagcccgcattcaatttgcatctacaacattgtttcacttcttgtttgtgcctttgtctatcgggcttgtgtttatggttgctttgatggagacgctttatgttgtcaaaaaacaagagacctatctcaaaatggctaaattttgggggcatctctttttaattaacttcgctgtcggcgtcgtcacagggattcttcaggaattccagttcggtctgaactggtctgattattcccgttttgtcggagacgtatttggagctccgcttgcggttgaagcgcttttggcgttttttatggagtctatttttatcggattatggattttcggctgggaccgtttatctaaaaaagtgcatttgctttgcatttggcttgtgtccttcggaacgattatgtcatctttctggattttgacggcaaactcattcatgcaggagccggtcggctttacgattaaaaacggccgcgcggaaatgaatgacttcggagcgcttttgacaaaccctcagctttgggttgaattccctcacgtcattttcggagcgcttgcgacgggtgctttctttatcgccggtgtcagcgcatttaaattattgaagaaaaaagaagtgcctttcttccataaatctttcaagctttcgatgattgtcggtctgatcgccggtatcggtgttgcgttcagcggacatatgcaggctgagcatttaatggaatcgcagccgatgaaaatggctgccagtgaagcgctttgggatgacagcggtgatcctgccgcgtggacggcttttgcgaatattgatacgaataaagaaaaaaacacatcagaaatttcaattccttacgcactgagctacttggcttaccagaagttcagcggcagtgtgaaagggatgaaaacacttcaaaaagaatacgaaaaaacgtacggaaaaggcgactatatcccgcctgttaaaacgacgttctggagtttccgcattatggcgggagcgggtgcgcttatgatttttgccgcgattgcaggctttattctgaaccgccgcaaaaagcttcatacgagcaagtggtatttacggggcatgatcgcactgatcgcattcccgttcattgcgaactctgccggatggattatgactgaaatcggccgccagccgtggacggttatggggcaaatgacaaccgcacaatccgtttcgcctaacgtaacgacgggatctctgctgttttcaattatcggtttcggcgtcatgtacttgattttaggcgcgctgcttgtcttcctattcgttcgtgaaattaaaaaaggtgcggaccatgatgatcacaaggatgttcctgtatcaacggatccgttcagtcaggaggtctaccatggggtcacttcatgatctttggtttgtactcgtttcagttttgtttgtcggatttttctttttagaaggttttgatttcggtgtcggcatttcgacccgatttcttggccataatgaattagaacgcagagtgctgattaacaccatcggcccgttctgggatgcgaatgaggtatggctgctgacaggtacgggagcgatcttcgcggcattcccgaactggtatgcgacgatgctgagcggatattatattccgtttatcatcatccttcttgctttaatgggccgcggggtggcgtttgaattccgcggaaaagtgaatcatttaaaatgggtcaaaacatgggactgggtgattttcttcggcagccttatcccgccgtttgtattcggacttatcttcacaagcttgttccgcggcatgccgattgacggccatatgaatatgcatgcgggtttctcagatattgtgaacgtgtattccgtccttggcggagcagccgtcacccttctttcattcctgcacggtttaatgtttgtcgcactgcgcacgatcggtgatttacaagagcgtgcgagaaaaatggcaaaacgcgtaatcggtgttatctttcttgttgtacttgctttctttgcgatgtctgcatacgatacggatatgtttacacgccgggcaaacatcacgattccggtattcgtgctgattgtcatctgcaacgttcttgctgttgtgttcatgagcaagaaaaaagacggctgggcattcggtatgaccggcgcgggtcttgctttgacagttgcgatgatttttatctctctgttcccgcgcgtcatggtcagctcgctgaaaagcgcgtatgacttaacagtagctaacgcgtcttccggtgattattcacttaaggtcatgacaattgtcgcactgactctgctgccgtttgttatcggcagtcagatctggagctattatgtcttccggaaacgcgtcagccataaggagcctatgacttattaatgggaaaagacctgtttctttataaaggaatgaagcggattcttgcgatcattacgggattaacgattatacaaacggccgccatcatcttgcaggcggaatggctgagccaggcggtaaccggattatttaacgggaagcggattgcttctctttatccggttatcggctttttcctgcttgcgtttttggtccggcatgcggtaacagcggtccggcagaaaatcgtgtaccaatatgccgcacaaaccggcgcagacttaagaaaaagatttcttgagcaattgttccgtctcggcccccgctttgcgaaaaaagagggaacaggccggatggtgacgctggcgatggaaggcatcagccagttccgccgttatttagagctgtttctgccgaaaatggtcagcatggcgattgtaccggcggccgttgttatttacgtgttttttcaggataaaacatcggcattgattctgattcttgcgcttccgattttgattgtatttatgattctgctcggacttgtcgcacagaaaaaagccgatcgccaatggaagtcctatcagacgctttccaatcatttcgtggattcgcttcgcggactggagacattgcggtttttaggattaagcaaatcacacagcaaaaacatctttcatgtcagtgagagataccgcaaggcgacgatgagcacgctccgggtcgcgtttttatcatcattcgccctggatttctttacgatgctgtcggtggcgacagtggcggtgtttctcggcttgcggctgatagacggacaaattctgctcgggccggcactgaccgcgctcattctcgcgcctgaatattttctcccggtccgcgaagtgggaaatgattaccacgcgacgttaaacgggcaggaggcggggaaaaccattcaaacgattttggcgcagcccggttttaaagaagaaaagccgctcgaacttgatacgtggactgacggggatgaattacagcttacgcgtttgtccgtccgagaatcgatgtctgaatttcatctgtcctttaaagggaagaaaaaaatcgggattatcggggaaagcggtgcgggaaaatcgacactcattgatgtgctgggcggctttttagagcctgcgtccggtgagatcaaggtaaacggtgaatcccgctcgcatctgcagtcggacggctggcagaagcagctgctttatattccgcagcatccgtacatttttgatgacacgcttttgaataatatccggttttatcatcctgatgcttcgcatgaggaaacggcgcaggccgctgcttcggcgggtctttccgaactgattcgtgatctgcccggcggtcttgacggccggatcggcgagggcggacggccgctcagcggaggacaggctcagcgtgtcgcgctggccagagcctttttaggaaaccggccgattctccttttggatgagccgaccgctcaccttgatattgaaacagaatatgaaataaaagaaacgatgaaagacctgtttgaaaacaaacttgtttttctggccactcaccgtcttcactggatgcttgagatggacgaaattatcgtgcttgatgacggcgcggtggcggaaatcggcacccacgacgaattgatggcgaaacaaggcgtatacgccaaacttgtaaaggcgcaactgggggaaagaacatgagaaaagaagaatggattctgccgtatataaagcaaaatgcccgtttgtttgttcttgtgatttttttaggcgcggtgacgattttttcggcggcctttctcatgttcacttccggttttttaatctctaagtcggcgacaaggcctgagaatatcctgctggtgtacgttccgattgtggccgtgcgcaccttcgggattgcccgttcagtctcacggtacgccgagcgtctgacggggcaccatatcattttgaaaatcgtgtccgacatgagggtgcggctttacaatatgctggagccggcctcgctcatgctttcatcccgttttcggacgggcgacatgctcggcattttggctgaggatattgagcatttgcaggatgcgtttttaaaaacgattttcccggcggtttccgctttgctgctgtatgcggcctccgttatcggactcggctttttttcctggccgtttgccgcttttgcggcgatttacctgtttatattggttgtattgtttccggttgtgtcgcttcttgtgacgagagcgaaaaacatgaggctgaaaagcggccggaatacgctctacagccggctgacagatgccgtgctcggcgtgagcgactggatgttctcgggacgacaggcggcctttatttcctcttatgaagagaaagagaaggcatggtttgaccttgaaagcaaacgtcagcggtttacgagatggcgtgatctcgccgcgcaatgcctcgtcggcggcttcatattgatcatgctgttctggacggcgggtcagtatgcggacggcagcatcgccaacacgatgatcgcggcctttgtgcttgtcgtatttccattgacggaggcgtttctgcccctttcggatgcgctgacggaagtgccttcttatcaggattccatcaaaagaatgagtaaggcggctccggagctgcgaagtcatgaggtgaagcagaccgatgagaaactggatgtatctgatgtgacacttacatttgataacgtgacgttttcttatgatcagcacagtcatgtgcttgaccgtttttccttcactctccgccagggggaaaaaatggcgctgctcggcaggagcggctccggtaagtcgacctctctcgctttaattgaaggcgccttagttcccgattcgggcaaggtgatgctgaacgggctggaaactgcggccgtgcaggagcagatttcctcagcggtggccgttttgaatcagaaacctcatctctttaacacgagcattatgaacaatatccggctcggaaacggtaaggcgagtgatgaagatgttaagcgtgcggcgcggcaagtgaagctgcatgattatattgaatcactgcctgacggatatgaaacgtccgtgcaggagacggggattcgtttctcaggcggggaacggcagcggatcgcgcttgcccgtattctgctccaagacacgccggtcattatccttgatgaaccgacggtcggccttgatgcggtcactgaacgtgaattgcttgatacgatttttgatgtttttaaagagaaaacgatcctctggattacacaccatttagcgggtgtggaaacagctgataaaatcgtctttttagaaaatggaaaagcagaaatggaaggaacccatcaagagctgcttgcagaaaacgaaaggtaccggaagctttaccgtcttgatgttccgatcagaacataaacagccgcaaacgagcggctgtttttttgtgcggtttaaaatctcttcttgtttggaatataaataggagacagaagaggaggtacagagatgaatataatggattggacggaacaggatgtgaaagatacgctgccgaaacgggaggcggacagccataaaggaacgttcgggacggcgttattgctggccgggagcgatgacatgccgggagccgcccttctggccggattgggtgcgatgagaagcggtgtcggcaagctcgtcatcggtacatcggcaggcgtcattccgcttatcgtcccggtgctgccggaagccacgtactggcgggacggctggaaaaaagccgcggcgggccagcccggggaaaccgtccgggccgctgccatcgggccgggccttccccaaacagacgaagtgcagcaggcggctgatcagctgctttctggcgattatcccgtcatactggacgcgggcgccattacgaaaagaacctattcaaagaggaaagctcccgtgatcttgacgcctcatcccggcgaattttccagaatgacaggccttccgattcaagagattcagcagaacagagcggaatatgccgcggaatgggcggagcggcttcatgtcacgattgtcctgaaaggaaacgaaaccattatcgcttttcccgacggggaatgccgcaggaatacaaccggaaacggcgcgcttgcaaaaggcgggaccggcgacacgctgacgggaatgattctcggcatgctgtgctgtcatcaagacccgaagcatgccgtattgaacgccgtccgccttcacggcgaatgtgcggaagtatggacgaaagagcgctccgcccataccttattggcgcacgaactttctgaactgctgccgcgtgtatggaaggaatatgaataaagaaaaggcgtcttcacagggaaggcgcctctttttgttttaaccttgatttcatcaggacataatacagcagcgacggaacggccaggccgatgacccaggcaatgtcgcctccgccgaatatttcagcgagcggcccgatgtaaaaggaggtattgatgaacgggatttctaatataatcgacaaaacgaaggcggccgctgtaatccaattgaccctgccgtattgcccgttgacgtcaaacatcgatttgacgtggtattttccgcggcggataaaatagtaatccacgaggttgatcgccgtccatggaattaagaaataactgatgaaaaagatgaaatttaaaaacagttccatgaaattgctttggcccaagagacttaatacagtacccgctgccgtcacacaaaggatcattaccactctcgttttcggcgtcaccttcagttttaaaaacggctccaaggtagtcgtggttgacataaaggctccgtataaattaaagacgttgatcgccatttgcccgaacaggacgatgatcagcataataaaggaaaacggaccgaacaatcggacaatctcatttcccgcattagcggtaaattccgggagcgccgtcgtcaaaatggcgccgagaagcatcatccagatggaactgactgacgtacctgcatagctgtaccaaaaagtatgcgatgccggtgttttgaccggcagataacgggaataatctgcgacatatggcgcgtatgccagctgccatgtggccaccgcgctgaccgccactagaaaaacaggcagatctaatgagccgggcacccagcttcctgaaggaatcggcagttgaaaaataagaattgttgcagcaaaaaaaacggcaaaggaggtccaagagaggattttctgcattttgtgaatcagatcatgaccgtagatcgtgagtaaaaaacagatggcgcttaagccgataatacaccatgaagccggaatcgggacaaagctgctcagtgtaccggctgcgagaatcgtactgctcgcaaagaagcccaggtagataaacatgaccaaaaagaggggcagaatcgctccgatcacgccgaattgcgcgcggctttgaatcatttgcggaattccgagctgaggtccttgtgcggaatgagacgccataaagattgcgccgataaaggttccgattataatggcggcgatactccaaaagagatcgagtcccattgtaacgggcagtgtgcctgtgactaacgtcgtaatatgcatattagccccgaaccagacggggaataaatctttagcctttccgtgtctttcgtcatgcggaatatgttcaatcgttcgcctttctactttcaatagataatctcctccgtatgttcttctttaacataaagacatagcttaacagattgacctgccgtttacaaattccagcatgcaggaaaaacattgtaaagcctcgctgacagccgttcaaagttttttttgaaaaacggtacaaacactgccgccaaaacgatttgccagggtttaaaaggcatggatatgattacggactaatatgtatgaaggagaaatgtgtcaatcttttgacgaatggaaccattattcgttaagctgaaagaatagtttactttgtgtaaatttcattaatgaaaaggggattgatgatatgtgtacaagtcttacattgaaaacgacagacggtaatcacctattggcgcgaacgatggattttgcatttcagctcggtacggacgtcgtgctttaccctcgtcagtacagctggaaaagcgaagctgacggcaggatgcataagacgaaatacgcatttatcggcatggggagaaatctcggcaatgttctgtttgccgacggcgtaaatgaaaaggggctgtcgtgtgcgacgctgtattttccgggctttgcgggatacgagaaagcggaacgggagggcacctgtcatatcgctcctcatgagtttgtcacctgggccttatcaaactgtgaatctcttgaagacataaaggaaaagctctcaatgctgacgattgtagagaagaagttaatgttattggatacggtgctgcctcttcattggattttatcagaccgcacgggcggctgcattgtcatcgagccgacaccggagggaatgaaagtatatgacaacaaacccggagtgatgaccaacagtccggaatttccttggcatgtgaccaatctgcgccattatatcggaatcaggccgcagcagtcagaaagcaaaacattgggcggaatgacattaaccgctttcggccaaggatctggaacgatcgggcttcccggtgattacacgccgccatcccgattcatcagagccgcttatctgaaagagcatttagagcctgccgctcatgaaacggatggcgttacggccgcttttcacgtgctgtccaatgtgaatattccaaaaggcgcggtgatcacagaggagaatgaaattgattatacgcagtatacgtcggtcatgtgctgtgacagcgggaactactactttcatctgtacgacaaccggcagattcacaaagtaagtctattccatgaagatcttgaacgtccggagccgaaagtatttgcggccgcggcggagcagaatatacaggagctgaattagctcaaaaaaaacaggacgcaattgtcctgtttttttatttaatacggatcagacggatggctttcctgttcagcctgctttgcagcctgttccgtatcagtagtgccgatcggcccgttgctgttgttttcggaaacctttttcagcccttccgcaacacgttttccgtagtccggatctgcttttgtgaaattctcaatcatttgatcctgaatgtctttccggcaggaagaaagcgtattgaccaagtttgtgatcaattcgttccgttcaaattccgaaaatctgcggtatgtttctccggcttggccgaaatgattcggccggtcgatcgcttcccgcttcacatcgccttcgacatgaggtgtatggtctttcccatcctgctttgcttcgttgagtcctcccataatggacggctcatagttgacgtgcgggttttgtccttctgcccgatcgacccgatactgcatttgcccgccttcctggttggtggcgacatgctttttcggcgagttgatcggaagctgcaggtaatttgcgccgacccggtaccgctgggtatctgaataggcgaatgtccgcccctgaagtaatttgtcatctgaaaaatcaaggccgtccacaagcacgcccgttccgaatgaggcctgttccacctcagcatggtagttttccgggtttttgttcagaaccaatttaccgatcggcttccaagggaaatcgtctttataccacagcttggtcggatcaagcggatcaaaatccagctcggggtgttcatcatcagtcatgatttgcgcatacacttcccattcagggtaatcgcctttttcaatcgcttcatacaaatcctgtgtcgcatggttaaagtttttcccctgaatctcttccgcttccttctgtgtcaggttgcggatgccctgtttcggttcaaagtgatatttgacgagcacggctttaccttcttcattgacccatttgtaggcatggacgcctgagccctgcatctgccggtagttggccgggatgccccaaggcgaaaacaagaaagtgatcatatgagtcgcttcgggtgattgggaaatgaagtcgaaaatacgctcgccgtcctgaatgttcgtaacgggatcaggctgaaatgcgtgcacaagatccgggaacttcagcggatcacggataaaaaagattttcaggttgttgccgaccagatcccagttgccgtcttcggtataaagcttaacggcaaaaccccggggatcacgcaatgtttccggggaatgctttccgtggttgacggtagaaaaccgcacaaacgccggagttttcgttcctttcttttgaaacactttcgctcttgtgtatttagaaatctcctcgtctccaaaacttccgtacgcctcaaagtatccgtgtgcgccggcgccgcgcgcgtgaacgacgcgctcgggaatccgttcgcggtcaaagtggctgattttctccaaaaaatcataattctccaatgtcgtcggtcctctattgccgactgtcctgacattctggttgtcagtgaccggatggccctgccggtttgtcagcgtgtcttctgactcgcctttaccggtcgtcttactggaaagcgtttcttcgctgtttttgttattttccattgttgaaccctcctttttgaacggtaacaatatgcccagcagagccgttttttaaaaccgattttcaaaagaagcggttattccgcgatcggcgtcaaagatccgccgttccatatttcgcccttgttcagcgtccagctgttttgataaaggctttgcgcgccttgattagccgccggacttaattgttcatcccatgtcaaaaagtacgtggtctcgggatacttttgcctgatcgcattgataaaagcagcataatcaaagcttccgatattgccggacggaccggtttcggcaaaggcaaacggttttttcagagacagcatttcatcatagcctgatatcgcatacggatcagtgaagtaagcgtccagaccggtaatatccacataagatgagcctgggtagaagtctgttttaaagtctctgttggcatccggcgaatacacccacaaaaggttatccaatcctcttgtctctgtcatatagcggtatatcttcttgtaaagctctttgtacagcgagattctttccgtgtctttttggttgtagcctgtcagcccccaccagaaccactcgccgttcatttcgtgaagcggcctgaacagaacggtgacgccttgatttttcagctgagtaaggccgtcggcgattttgctgagcagcgcctcaagccgttttccttcaacagttgaagggtccaggatgtttttgtactggctgtttgagatggccgttttatagtttccggatggaaaagccggatttgcgagatgcaggctgacctgagggaggccgccgcttttccagtatgagatcaagctgctgttgcagctgtaatcgatagtatcggtgatatccgctgtttccagccatcctctcccatagtcacagccgtagatggcgggagactgtcccgtcgcgtttttcaagcggttttcctctgtcattgaaaaagtgacatcgctgtacccgccgaacgtaccggacatgaccctgttttctgaacggttgggcaggtgcgccagccagttcatgatatcttttgtcgtctgctgggcatttgggtttacgggataaacggtgtgagccgatatcggactggcggctcctaagagtaataaaacgatagacaggcagactgctaactttttgagcatataaaagacctcctgatttttaggatgatgaaggatgtgaaacgataacctcacaatctccttctataacaaaatttccggaatccgccggcacgataaagtgatcgcctttgtgaatggggcatccatccagttctccgcgtcctttaatgacgcttgcgagtaaataccggccgggtgcggggaatgatgctttcccgctcacatcccattgataaactgaaaagaaaggtgtttcggcaagtgttgtaataagagcatttccgatccgatgctttgtgctttttacattttcatcggtatgcggaatacttgttacgtcaattgctttctgaagatgaagctcgcgtttattcccgttcccatccgtccggtcatagtcgtaaagccggtaggtggcatcagagctttgctggatttcaagaacgagcgtaccttcacataaagcgtgcagtgtgccgctcgggacatagaaaaagtcgccgggcttaatggggatgcggcggagcaggtgatcccactcgtttcgttcaatgtgccgaacgaagtcttctctcgtttgggcgcggtgccctaaaatgagctccgcctcttttttgcagtccaatatgtaccagcattccgtttttccgagttctccgttttcatgccgatgtgcatatgcgtcatccggatgaacctgtacggataagtccatatttgcgtcaagaatttttgtgagcaggggaaaggcgtctcctttcggatgtccgaacaggtcagggtgttcattccagagacgatgtaatgatgttccggaaaaaggcccgttccgcacgatggatgtaccgtgcggatgagctgaaatcgcccagcactctcccgtccgctcagaaggaatctcatacccgaatgtatcgcgcagcttcgtcccgccccataatctttctttaaaaaccggttccaaaaataagagtttcgtcattttcccgcctcccggtttgccgtctctaatgcgcgctccgccaatacgagcgaaccggcagcgccggagtgaatccctaattgagggggaacgatgaagtgttcaatgtcgggcagatcaatatattgattcagccgctttttcacgtgctgacggatagaagagaacagctgatgctgcttcatgacgcccccgccgagaatgatcttttcaggcgaaagtatgagaatatactgcacaagcgcttcagcaatataaaagccctcaagctcccacacttcctgctgatccgccagcagatatgcttttttcccccagcgtttctcaatggcggggcctgccgcgaggccttccaggcaatctgtatggtaaggacaattgcctttgtagccgtcgtccgggtgtcttctgacataaatgtggcccatttcaggatgagacagcccttgaacaaatctgccgttcatgatggcgcccgctccgatgccagtgccgaccgtcaaatagaggcagctgtccgcgtttttggccgcgccgaaagaagcttctccgagcgccgccgcattaacgtcggtggtgaagcctgcgggaatatccagagcgcttttgatcgtttgaagaatagggcagttccgccaggctgtcttcggagtcgcggtgatgcgcccgtatgtttgactgtcaggacggatatcaatcggcccgaacgacccgatgccgatggcgtctatcgggaaatctttaaagtaacggatgacctgtctgagtgtgtcatccggttctcccgtcggaaactccgctctgtccagaatggtgccgtctctttgtccggcggcacagacaaatttcgtgccgccggcttcaatacctccaagcatggccgtccctcctcatctgctaaaatccgttttgatcggaaacggatttgaaccagcggccgctttttttgacggtccgttcgcccccgttttccagattgacagatacaaagccgtagcggtttttataagcgtttgtccaagaccagttgtccatgaaagtccacaggtgatagccttttacatttgaaccttctccgatggcccgatgcacccatttcagatgttcctggataaattcaatcctgtaatcatcctgaatgatgccgttttcatcgcggaagcgttcctcgccttctactcccatgccgttctcagaaataaaacactcgatatttccgtaatgttctctgagattggtgagaatgtcgtagattcctttttcgtaaatttcccacccgcggtgagggttcattttccggccgggcatgacgtacggatcgaagaaacgctcgggcaggaaaggggcatgcggattcggaacatgttcttttgccttgacgcgcctcggctggtagtagttcacgcctaagaggtcaaccgtatgctcctgaatgaggcggagatcttctttctcataatgcggcagaaagccttccgccttgagaatctcgacaagctcctcaggaaattcgccccttacggcgggatctaaaaatgagcggttgaaaaaggcgtcggcaatccgggacgctttcagatcttcaggatgtgagcttctcggataagaaggcgtcagattcagaatgattccgatttgtccgtcctgtttcaattctctgtaggctttgacagcccttgcattcgacagcagggtatggaagccggcctgcaccgcttcttgaaaattaacgtgattcgggtagtgaaagtcgtataagtagccgccttcaatcggcacaatcggctcgttgtgagtgaaccattttttcaccttgtcaccgaatagcgaaaagcatgttttggcgtaatgttcaaacgcgtcaacggtgttccggctgacccagccccccttacgctgaagggcgagcggcatgtcaaagtgaaacaaattgacaaacggctcaatgtgatgggcaagcatttcatcgatgacgtcctgataaaacgcgaccgctttctgattgacctcgccagttccgtccggaatcaatcttgaccaggaaatagacagccggaaggagttgtggccgatttctttcatcagccggatatcctccttgtattgatcgtaaaaacgtgacgtgtcgccggggccgacgccgttaaaaaaacggctcggctctttttcataccagtaatcccatatgttttggctttttccgtctctgtcggcggcgccttctgtttgggtggcggaggcggaagacccccaccagaatcctttcggaaaacgatattgaatatttgaatcagtcaattgatttctctcccttactgcgattttgattacatactcatgctgtcatcccgggcatgctgctcggtctcagcttctttttcctttgccatgtttaatttgtccagcgctttaagaaacgggaaccagatgacaaacacaatacagaggttgaccagctgcataatgccgcccatggcggaattggtcgccataatcccgttaatgaatagggggacggtccaaggcacggtcacgccggtaggagggggcacgatccccgccgacatggccaggtaggtgacaagggtgacaaccatcggcgcgatgacccacggaatgataatgatcgggttcatcacgatcggcagaccgaaaataaccggctcattgacgttgaaaatgcccggcgcgagaccgagtttggatatctgtttcatctgtttgcttttcataaaaagcaagatggcgatcactatggccaatgtcattccggttccgcccattccgacggtgtaaatctccataaacggcttagaaataatatggggaatctcttttcccgctgtatacgcagccaaattttcgacctgtaatgtattccaaatcgggtccatcacggaattgataatgatctgtccgtgaagtccgaaaaaccataaaatctgaataaagaaaacagcgattaatgtaggaatgatgccgcttccaagtccgacaagcggggcttgaaccgtatgataaatgacatcatgcagattggtgtgaaagatctgggtgacagccgcgttgatcaagaggaagacggtaagcgtgataaaagccggaatcaatgcggcgaacgatttagcaacagccggaggaacaccggcaggcatcttaatcgttaagtttctctggacgattcttctgtagatttcacctgacaaaaacgcggttatcatgccgagaaacattccttttgctccaagccggtcaaccggaatgacgcctgcgaccgctttgcccgtttccggctctaagacgaaaggggtgagcagcagaaaagaaaccaatgcgatcgctccgccgaatacggcctccacttcgtagcttttggaaaggtaatagccgatcccgaagacgacaaaaatagacataatccccatcgtcgccgtcgaagcgccgccaaatccggattgaaagacagacagggcggagctgctcatgattttgtttaaaaacggcaggttcgtcagcacgacgaacaccgaaccgaaaatggtcagcggaaacgccagcataaaagcatcccgtaaaacttgcaaatagcggttattgtttaatttgcccgcgatcggaacaaggaattggctgattttctcaaacacgtcttcacccccggctttttataaattttttgattgaaataagtcgagcatttctttaaccagctctttcattgagagcgctgacattaagtggtcttcagcatgcataaaaagcagggagacatccgtcttggcgccgccggcttctttttgaatcatctgaaaatggatgtcgtgcgctttccccagttcttcttcagcctttgtcagaaaggtgtctgactcatctggccggccgtctttataagcgcgtatcgattgaataatacagctgcgggcattaccgctgtgaagaatcagctgaaaactgatctgttcatccgtgtacgtttccatgcttatcgcctcctttatttgttctcaatcaaggcaacggcctgttcgtatgcttttttgccgtctcccatgccgtaagccatcatgtcaatcacatcaacggtgatgtgaagcgggtccgcctctttctgaagctcgccttttaaaaaactcatctgcgggccgatcagtacgacgtctgcatctttcatcgcttcttttgctttatcctgtccgactgcccaaatctcggcctcctcaccgatggagctggcgtaattctgcattttcgtgacaagaaggctggtggacatgcctgagctgcaggctaataaaattcttttcatgaggaatcccttctttcataaagttaaaacgttttcatgaatattataatcttttgaaattaaatgtctatacttttaaaatataaaagtttaacttttcggatttttgacacaaaaaaaccttttaagattcaacttaaaaggtttttttctcaagcgagccataacagccataaataaagtccgatcagggtgatgaataacgtcggaatggttaatagcagacctgttttgaaatacattccccaggaaattttcacgtttttccggctcagcacgtggagccataacaatgtcgccagcgacccgatcggcgtgattttcggcccgaggtcagaaccgataacattcgcgtaaatcaatgcttctctcagcagcccgtgagtgtccgttccgctgatggctatggcgtcaatcatcaccgtcggcaggttattcataacggaggagaggatcgcagcgataaaacccattccgagtgtgcccgcaaacaatccgtgatccgccgctttctgaataagctgagaaagaagatccgtcagtccggcattccgcaagccgtacacgacaacatacatgccgacagaaaaaaacacgatggcccacggggcgtccttgatgacttgtttcgcagggacggcggggcttcgctgcgccagaatgagaaaaatgaccgcgatggagccggcaacgaaggaaacgggtatcgacagcagttcgctgacgaaatatccgatcaataaaacggccagcacagcccatgataaccggaaaaggcgctcatccttaatggcggatgccggatgtttcacaagaccggtgtcataccgtttcggaatgttttttctgaaatagagatacagcaccaaaatgcttgccgccagagaaaaaaggttgggcaccagcatgcgtgatgcatattcaatgtacccgatatgaaagtaatcggcggatacaatattgaccaaattgcttacaacgagcggaagcgaggtggtgtcggcgatgaatcctccggcgataataaacggaaaaaccagcttttcaggtaaattcaaagcccgcaccatcgccagtacgatcggcgtcaaaatgagcgccgctccgtcattggcaaacagggcggagacaacagcccctaagaccgacacatagagaaacatccgcagcccgctgcctttggccgccatggccatatgcagcgcggcccactcaaaaaaaccgatgctgtcaagaattaatgaaatgataataatggcgataaaggcaagtgtcgcattccagacgattcccgtcacttccgcgatatcgtgcaggctgactgctccggcgatcaaagcgagaaccgctccgccgcaggcagaccagccgattgatacatgtttcggctgccatatgacaaacacaagtgtcagcacaaaaatcagcgctgataaaaccgcaactcccaagaatatatcctccttaccggcatgtaacagtgacttctttttgccgcaatgtctgtaaaacttcgtccttttcatctatctgctgcagaatcgagcaaaccagcgcgtattccggaccggacggatgaatggcatagtaccgccactggccctcgcgtctttcccgcacaaggccggcgttctttaatttccgcaagtgctggctgatgccgggctgacttatatcaaaaatagccgtcagctcgcagacacaatattccttatcctccagaagcttcagcatcaaaagcctcgtcgggtcgcttagaagcttgaggcactggctgatccctccggaacttaaagcatgatgccgccgttccatgcgctcactcctttttcacactattatataagcggttgtttatataagtaaacgacaatataaaaaagccggccttgcaatttttgcaaaaccggctcatgtttatttttggaacagttttttcgcttcatccattgctaatttatttcccagtgctgaataatcaagccaaggctgatcggcaattttatagacgtggtttgctttcacggccttcagccctttccatacagcgcttttttgcaattctttataggcttgctgtgacttgtcgtctctgttaacgacgacgaaaatcgcatctgcgttgtaatcaggcagcacttcttgagaaatgacttcataagggcgggaggtgttcatttctttaatgccgtcagccggtttcagcttcagatcgtcaaacagaatcggtcccatcgggcggcgtgtgctgaagacgcgaagctcttttgcgttcacgcggatcgccatgactttggcgtttttccctaattccttattcatcatggatctgacttgttttgtttcatcttcgtaatcctgaataaatgttttcgcttctttttcacggttgacgatttttccgatgtcttttaaatgatcgcgccaagtgcctttatcaaggtcgaaaacgtgtgtgtttccgattttcttgtattttgacacatcttttcccgcaaattctttatcaagataaatgttgtcagggttcagctcaagtaaagcttccatatccggatctgaggcagggccgagttttttcgtgtctttcagctgatttttcacatgagggagaaaatcttttaattctccgcccacgacggaaccggcaggtgtaacgccgagagccagcagatcatttgtcaggtgaatggacatcgaagcgattttatgatcgccggatttcttttttgactccggctgtgttgaatcggattggcaggcagccagtaagaaaatacacatgaaactgacgagcgcaattatttttttcatgggaatactccttgttttatgatttgattttcatgacgagatagagaaaatacggcgcgccgatggctgccgcaaccacgccggccggaatggcgttcggctgaaacaaagaccggccgatggtgtctgccgcgacaagaatgacaagtccgattaatcccgcaatcggaataatatgctgatgcatggtgccgacgagccgtcttgccaagtgaggggcggcaaagccgataaagccgattccgccggccatcgccacactcgcgcaggacaagccgaccgctatggcgatcagcatgatcctttttctctgcacgtgtgcgccaagccccgcggatgcctggtcaccgagcattaaaatattcaaagagcgggcgttcagccatgcaagcggtgcgagaatgccgatccagggcaatagcgaccacacgtgaatccaatccctgccccagacgtttcccaccagccagcgggaagcgaatgtataagtttcttcattcaggcgcagcgacataaacaatgtaacggcgctgaagcccgcggaaacggcgatcccgactaacagcatgcggatcgttaaaaaaccgttcagcctgtcgtacgtaagcactacgatcagcagggcggcgagtgttccgcccgcaaacgtaaacagcgggatgaacatcgacgcttgcgcctccaaggaatgaaagaatgtgatatacatcatcaaaccgaaggaagcgccggcatgcagtccgagaatgcccggatcggcaagcggatttcgggatacaccctgcaaaatagcgcccgacactcctaaaccgatgccggccagcatcgtcaccagaatccggggaagccggtaatcgaataaaacggttgtgctttgaaacgtgccgtatccgaacagcgtttttcccacggtgagaggagaaagccggaatgagcccgtatgcagcccgatcagaatcatgcaaacggcgatgaccagcagaatgagtcctgccgccgccgctttttttgtttctttctgcactttcatttataagtctctcccttccttgcgggcaatataaagaaagaaagggacaccgacaagtgcgaccataatgcctatcgccaattctctcgggggactgaccgtgcgcgaggccaggtcggccaaaatcaatagaatcgcgccgagcaacgcggacatcggaataatcagcctgtacgtaacgccgacgatcttgcgggcgatatgggggatgaccagcccgacgaagccgatcgcgccggcagcggaaacagacacaccggcaagaacgacggcgatcattaatccggcggcacgcgtcagcgccgtgttcacccctaaattcgccgccacgtcatttcccattgagagaagggtgacggaccggcccatgaatgtcgcgagaatgatgaagaccgcaatcacgggaacaaggacttgtaaatgagcccacttgatccccgacaccccgccggcgtaccagaaggccaaatcctggcttaaatcgtaataaatcgccacaccggtactgagtgaatgtaaaagcgcggccacgaccgccccggcaagcgtcacctttaaaggcgtcatgctgccttttcccgccgcactgataaagaaaatcaagccggtgcttgccagtgctcccaaaaatgacatcaccatcagcagggcgtataacaaatgagggaaaaaagcaaagctgagcgcaacaacaaacatggcgcccgcgtttacgcctaagacacccgaatcggcaagcgggtttctcgtgacaccctgcatgagggcgccggctgcggcaaaagcggctcctgtaacggccgccccgagcaccctcggaagacgcaattcatgaatgatctgctggcccgttatgttcggattataatcagcaacagccgaccaaaccgtatgtaaagtaatgtctttcgcgccgaatgagacggcgaaaaaaatagatacaagcagcccgatcaccgcgatcaggaagaaaaccccgttttttaagatgctgatcagacggtttgcggacgtgacagaatcgctcaaaaatcaattcacctacttttatgatcattgtccggtatttattgaatatgagaatcattttcatttgaaccatcatattataccgggctgattttcaaaacgcaatagagcgttcaacaatgatgtcctttttttctctcatgtttatattgtaaaaaagaagtgaaaaacgtgaaagaggaaatcgctatattcagaaaggagggaggcaaatggcgggagaacgaaagcctttgccgattgaattttaccagagaccgtcagtggagcttgcccctttattgctcggctgtctcttggtgaaggagacggacgagggaacggcttcaggttttatcgtggaaacggaagcttatatgggagcggatgaccgggcggcgcacagcttcggcaaccggcgcacgaaacggacggaaattatgttccatgaggcgggccgcatttatacatacgtcatgcacactcatacattaatgaacgtcgtcgccgcggacatcggcattccgcaggccgtgttaatcagggcggcggagcctcatgaaggacagttcctgatggagagcaggagaccgggcagacccccgagagagcggacaaacggcccgggaaaactgacgaaggcgatgggcatttcaatgaacgactacggcggcatgatcacggaaccgccgctgtatattacggagggctttacgcctgagcatatatcaacaggcccgagaatcgggattgacaacagcggagaagcccgggattatccgtggcgctattgggtgacggggaaccggtatgtctcacgctgaccatgtttataaacgctgataacaggggaaagacaaggtaaaagaaaggggattcagacattgaaaaaatttttcaaaacgattatcaaatgggcgcccgtcatctatccgatcatcagaaaaatcataaaagaacggaaggcatctaagcggaaccgcatgtccgcatcccgaacagccggctgatccggctgtttttttacggtcttggcatcggattgccgcattgacttgaaatcctccccagtatagaatttacatacatttaccccttcctcattctttttgcccatttttcacgtctgcatctgatctgataggaggtttttctcatgcttcatgggcggcttcgtgaacttctgcgcttgcttttagctgctgaaacaccggttacaagctcagtcatcgctgcaaatgtaaaggtaacgacgcggacggtccgcaatgacataaaggaactgcaaaccattgtagaaaaacacggcgcatccattcaatctgtcagagggagcggctataagctgctgatccggaatgagcagccgtttaaaaactggcttcaggacaatttccagcagaacagcaccgtgccgatttttcccgatgaacggatagattacctgatgaaaagaatgcttctggccgacggctacctcaagctggatgacttggcggaagaactgttcattagtaaatccacacttcaatctgatttaaaagaagtcaaaaaacggctccgcccctatgacatcattttggaaacaaggccgaactacggctttaagctgcgcggcgaagagctccgcctccgttattgtatggcggaatacttagtggacgaccgcgagcccgagcctgatctcctgagtgaaaaggccggtattctgccgaaagacgacattcatgtgatccgcacagccattatgaagcaggttcgaaaccataagatcccgctttctttcttcggcctgaacaatctcatcatccatatcgccattgcctgcaaacgaatccggacagaaaactatgtatctctcatcccggaagatcttcatgatattaagcttgaaacagaatatcagtcagcggaagccatcgtaaaagagcttgaatctgcgctttcggtcacctttcccgaacaggaaaccgcctatatcgccattcacctgctcgggacaaagcgcatgacccagtcacaattggaaggaaaagagcttacaaggctgatagacggggaaaccagccgtttgacggaggccatgatcgaagccattgagcgggagctgaagctcggaatcacggacgacaatgagctgaaagcgggtcttgcgctccacatcaagccggcgattaaccgaaaccggtacggaatgaacctgagaaacccgatgctctccgccataaaggaaaattatccgctcgcatttgaagcgggagtgattgcgggaatcgtgatcaaggagcaaaccggcattgatattcatgaaaatgagatcggatatttggcgcttcatttcggagccgccattgaaaggagaaagacggaacggccgcctaaacgctgtctgattgtttgtgcgtccggcgccggcagcgcgcagcttttaagagaaaagctccgttcccggttcgcaaagcgtcttgaaatcgtcggaacggctgattactgcagccttgaccagctttcctttgagtcgattgattttgtggtcagcacagtgccgatcaaaaaagacctgcccgttcccgtattgaaggttcatacgctgttgggcggcggggattttacaaaaatcgacgccatgctggaagaaaagcgggaacaattgaactttctgaaaccggagctggtatttttgcagcaggatctggagacgaaggaggacgtcatccgttttctcggacagcaggttgcagaagccggcctcgcttctgattctctgaccgattctatttttgaaagggaagcgatttctcctacgagtttcggcaatcttacggcgattccgcacccgctcgttccgcagacagacacgacgttttgggcggtatgcacgctgaagaaaccgattgactgggcggataagcgtgtccaatttgtctgcctgctctgcgtcgagaaagaaagcaaagccgacctccagcatatgtacaaatggctcggcggcatgttagatgatccggccgcggtaagccgtctcttaaaatgcacaacctatcaggaggttttacgagtattcagagacaaacgatcagagaaagaccgggatacaccttttttccgttagcagcggaaaaagcctgagtagttatgaaagcgatttcataatatgatggtactaacatcgagacatacaaaatatcaaactttcaggaggtcttttacatgaatatattactcgtttgtgcagcagggatgtcaacaagcttactcgtcaccaagatggaaaaaagcgcgcaggaacaaggaaaagaatataaaatctgggcggtgtcaggcgattcagtcaaccagcatattgataaagcggacgtattgctgcttgggcctcaagtccgttatttgcttccgcagctgaaaaaattgggtgaatcaaaaggagtgccggttgaagtcatcaataccgtccattacggcacttgcaacggagcggaggttctgaaatcagcggaacagctcggaaacgcatcgtagaaaggggcgggccgtgtgaataaggtgaaccagtttttagaagagaaagtcatgcccattgccggaaaaattgcctcccagcggcatctgcaagcattgcgtgacgggatcatcctcaccatgccgcttatcatcatcggttcgttttttctgatcatcggcaacctgccgattccgggatatgcggatttcatggcaaagacgttcggaagcgcctggtctcaaaaactgcaatatccggttgatgcgacctttgaaatcatgggtcttgtcgccgctttcggaatcgcctaccgcctggccgaaaaatacggggtggacgcattatcggccggtgcgatatctttggcggcgtttctcttggcaacgccgtacaaagttccgtttctgccttccggcgccaaagaggaaatcatggtgggcggcggcattccgctttctctcatgggaagcaaagggctgtttgtcgcgatgatcatcgccatgctgtcgacagaaatttaccgcttgatcatccagcggaatttcgtcttcaaaatgccggacggtgtgcctccggcggtcagcaaatcgtttgtcgccttaattcccggctttgccgtcatctttctgatctggggtgcgcgtttaattgtcgaagcgacgccgtttgaaaaccttcataacattgtaagcgttgtactggggacgccgctctcgaatcttgggggaagtctcggcggaagcctgatagccgaagcggttcaaatgctcttgtgggcgtgcggattacacggggcgaacatagtcggcggcgtcatggcgccgatctggttcggagcgatggatgccaaccggattgcgtttcaggcgggcgatgcgcttccgaatattttcacccagcagttttttgaaatctggatcaacatcggcggaagcggcgcgacactggcgctcgtggtcaccatgtttctccgttcgcgaagcaagcagatgaagcagcttgggaaactcgccatcgggccggccgtctttaatattaatgagccgattattttcggaatgccgatcgtcatgaacccgatgcttctcattccgttcattatcacaccgcttgtcacactggtccttacctatatcggcatgagcaccggcctcgtcgccaaacctgccggcattgccgtcccatggacgatgccgccgattttctccggctatcttgccacgggcggaaaaatatcaggggctgtcatgcaggcgattaatatcatcacagcctttatcgtgtactatccgttcttcagaatgtgggattcgcaaaagctgaaagaagaaaacgaacttgaacaatcgcaggcgccagccgtacagggagacgaaaaagccgtgctgtagagaaagggagtgaaacacatgaatgaaaaaatggaacagaccatttttcagatcatcctgcatggcggcaacggcagaagcgcatcaatggaagccattgccgccgcaaagcggggggacagagccatggccgaggaaaagcttcaggaagccgcaagggaactgacagaagcccatcattaccagacagaattgatccaaaatgaagccggcggagaaaaaacagacatgacgcttttaatggtgcatgcgcaagatcatttaatgaatgccatgaccgtgaaagacttggccgctgagttagtcgagatttacgaaaaagtgagtctgcaaggaggagcaaaaatatgacaaaaggaattaaaattgtaacgatcggcggaggttcaagctatacaccggagcttgtggaaggcatcattaagcgctatgaggaactgcctgtcagagaattatggcttgtcgacattcccgaaggcgagaaaaaactcaatatcgtcggcacgcttgcaaaacgcatggtcgaaaaagcgggcgttccgatagagattcacctgacgcttgaccggagagaagctttgaaggatgctgatttcgtaacgactcaattccgcgtcggccttcttgaggcccgcgccaaagacgaacggattccgttaaaatacggcgtaatcggccaggagacaaacggtccgggcggtttattcaaagggctgcgcaccatcccggttattctggaaatcgcgaaagacatcgaagagctttgtccgaatgcatggcttgtgaatttcacaaaccctgccggcatggttaccgaggccttgctccgctactcgaatctgacaaaagtcgtcggcctctgcaatgtgccgatcggcattaaaatgggcgtcgcaaaagcattggatgtggatgtcagccggatcgaagtgcaatttgccgggctgaatcacatggtcttcggattagatgttttcttagacggcgtcagcgtgaaggatcaagtcattgaagccatgggagacccggaaaacgccatgacgatgaaaaatatttccggagcggaatgggagcctgaattcctgaaggcgctcgatctgattccttgcggctaccaccgctattatttcaaaacgaaagaaatgctcgagcatgaaatagaagcgtcacagacggagggcacacgcgccgaggtcgtgcagaaggttgagaaagaactgttcgaactgtacaaagatccgaatctcgccatcaaaccgccgcagctggaaaaacggggcggagcgtactacagtgacgcggcctgcaacctgatcagctccatctataacgacaaacatgatatccagcccgtcaatacaataaacaacggcgcgatcgccagcattccgaatgactcagcggtcgaagtgaactgcgtcatgacgaaagacggtccgaaaccgatcgccgtcggtgatctgccggtgtctgtccgcggactcgtccagcaaatcaaatcatttgagcgcgtcgccgctgaagcagccgtcacgggagattatcaaacggcgcttcttgcgatgacgatcaaccctcttgtcccgtcagactccgtggcaaaggccattctggatgaaatgcttgaggcccacaaagaacatctgccccatttctttaagtcgattgaagcataagagcagtaaaaaaacccggattcgcttccgggttttttgcttattttgattcgcttagtgaggcgactttcgtcgtccagccgaacacgtcggcttccgcgcctttttgaatgcctgtaatggtatcgtacaatttcttcgagatctctccggtttcaccgctgccgatgacaagactttcatcattccagatcagttcgccgaccggagaaatgaccgccgccgtaccagttccgaatgtttcttccaatcggccgtcacgatgcgcctggatgatttcatcgatcgaaatcttccgctcagacacagtcagtccccaatgtttgagaagggtgatgacggaatttctcgtaattccttcaagaatgcttccgttcagctccggtgtcacgatctcgccgctgattttgaagaagatgttcatgctgccgacttcttcgatgtattttttctcaatgccgtcaagccataaaacctgggaaaatcccttctcttccgcaacctgctgcgctttcaggcttgatgcgtagttgccggcggttttcgcgtttccggtgccgcctttgacggcgcgcacgaattcgttttccacggcgatttttaccggtttaatgccttctttgtaataagagccgaccggggaaagaatgataaacagcttgtacgtatgggatgccgctacaccgaggaaaggctcagtcgcaataataaacggacggatataaagggaagtgccttccgctttcggaatccagtcttggtcgatggctacgagctgtttcaggccttcaagaacaagctcttcatcaatgagcgggatgcaaaggcggtcatttgactggttcaggcgctccatatttttctccggtctgaacagaagcacttcctgatccttcgttacatacgctttaagcccttcaaaaacggtttggccgtaatgataaaccatggccgcaggatccattgagatggactgataagggataattctcggatcataccatccttgaccggcgtcgtaatccataacaaacatatggtcggtgaaaattctgccgaacgcaaggtcatgggggtccggtttcggttttttggctgaagtcaattcaacacgaatgtcttgtttcataatgttctgtctccctattggtgttattgtcaaacttatttgaaaataatttatattctattgtataccttcaacaaatattcgcaatagttttcctcaaatttgtgaaaaaatcaaaatcacataaaaagcaggggagagaatgccccctgcgtgttcgtttttacgtattctgtcatcaccgtgctcagtgaaccgtcaccttgccggttttgtaaaactgctccattgctttatcgacgtacacccagcccttccaggcgatatggatggtgtctttcataaagtacggatcatattcgtgcccggataagtcggcaacctgaaagcccttcgctttaatttgcttagtgacttttttgtagtaatcagtccggccttttttcgggaagccggtgtagtcataccattttccgttgaccggaataaccacgaacatcggttcagcgcctgcatctttcagaatgtccagcatatcctcaaagtcgtgatattcgactgatttggcgtatgttcttcctttgttgattcctttcactctctttactttcttcttaatctttttataagaagcgtcatcgatatagaaaggattggacttggagctccgttctcctaattgagcggcggctgtttttaactctgaccacgatttccctttcaggttttcagagatcgtccgttcagggcccttgttttctcccattgaataataaagatcttttttctcaagcagagaataataagcttttgcagccggcatgaccgctttcactttccatgattgtccgttgaccattcccttgtacaattcagaaaggacggcatcatgctgaacgactttaaaacggagcatgcgcttcatcatgttctttttgaccgcgggatcaatctggttattaaatgctaaatccaatgcctgaagtgatgaaaaattcggcgcaaagtgctgttcatcagaaccttttttgataaaccattgcggagaaacaatgaataccagttttttgcccttcagctgctgataatgcgccgcaaagttcacggcgtgtatcaaggattggtccccgccttttccgacaagataaggcgtaaagccttggttgttcacttggaaatagttggacgggtgaaactcatccagtcttgaaagctcggaagaaccgaaaatcggcagatacttcgagtcttcgaacattttgttttgaagatagagtccctggaacatattcggatttaaggctgccgccgactcttcgacacgtttttcaggaatgaagcgcgtaagccatgaagccggaactgcgatagctccgacaaacaggacgaacgctaaaataattggtccaaagaaacgctttttcatttacttcaactcagtcagtttgtttacaatgttgtttggcgtattccactcgtcacggtcaaattcagtgatcggcactgtaatgccgaagcggttttcgatggcgacaagcagctctacagttccgaaagaatcaagcagtccttcttcaaagatttcaatatcaggattttctttcacagcgtcctcctgacaaacttcagctaatacgtctaatacttcctgtttaaattccatgtgttttcaatctcctttagtgatgaaatggttttcctgagaaaatataaaatccgaaacatacgaaatggaatgtgatgacgatggctaaaaaggccgtaaaacgattggcgggcagccacttgtatttcttattccatttctcaaaaaagttatacccggtcattaatacggcgtggtacaggccgtatacaatatattgcagggcgagtccgtgccagacgcccatcagcatgaacagcaggaaatacccgatgttcgagacggccatccggttctttatccattttttctttgtcatccagaaaacaaagcgcataaatacgtagtctctgaaccagaaggataaggacatgtgccagcggttccagaagtctttaatgtttttgctgataaacggcttattaaagttttccggagatttgatacccatgatatagcttacaccgacggcaaacatcgtgtaacccgcaaaatcaaaaaacaggtacaagctgtatccgtacatgtacagcacattaccccacagtttgctgtgggtgatatgagacagattcataatgaaatacgtgttaatcgcatatccgataatgaatttgtacaagaaaccgataaaaattttatgaatgccggtatacagtaaatcagcgtattctccctttgtccatactttctgttcgtccttggcaaatctgcggtatctgtcgatcgggccggaagaaatggtcgggaaaaacataataaagtacaaaaggcggtgaagcggcattttttctttaatcagtccgtctctcgtttccatgatcagctggacgcctttaaatgtcaaataagaaattcctaagaaactgatcaggttatgaaccgggtgatgaggcaccggcgggaagaaaaacggccataatttagataaaaacaggggtaaaatagacgcgatcacggccatactgaagacaaagccgctgttggctttcagtctgtaagcgagataacccctgattaaaagcacctgccacaacgtaaagatacatagtgcgatcacgccgtgcagatcatgcgcgaaaatcaaagccaatacgatgatggatataaacatgttgtatccttggaatctcttgccgttcagccctaaaaaaatcgtcggcaaaagaaggattccaagtaagataaagaagaaaaacgagctgtaaggcgtcatacaagaacctcttcgccaatgcgtttacggtcgatttttccgttcgcagtcatttgaatgtgatcctgataaatgaattttctcggaatcatgtaggccggaagcgaagcggccagttctttcttaatggcgcttgtcagctggaattctttttcaaaatcatgtttttcaggcacgatggcggcaattaaatattcgactggtccgttaggctgatacgggatgacaaccgccgtgcgcacatattgagactgccttacatgtacttcgatttcctccagctccatgcggtagccgtgaagcttaatctggaaatcaaggcgtccttggcagaaaatctgaccatcctgaacataaccggcatcacccgtatgatatgcccactggccgtcaattgagaaaaacgctttttcagtcagagacggttcaccgagatagcctttgctcacgctcgggccggcgatgatgatttcccctttttctccgtccggaagcttattcccgttttcatccatgatgaagatattcatatcgggttttgcaaaaccgacgggcagagattcatgttcatcgatgatctgctgcgtaatttcaacggaggtgacggcaaccgttgtttcagtcgggccgtatgtattgaatacgcgggccttcggaaaacggtttaacagctcctgtgccacggcagccggaagcgcttctccgcaaaacataaatacttctgtctcaggcaggagctcctgcgtaaagccggggtccatcagacacatttggacgaaagacggcgtcgatgtccagacgttcagtttggatttctccagctcttcaaatagtactttcggtttattgattttgtctttcgttacgcaatgcagcgtacctcccgtttgaagcgaagggaaaatgtccatgacagataaatcaaaagaaaacggcgcttggtttaagaatgtcttaccatcgcccacaggaaaatccctgcagatccagtcagtgaagctttgcaggttatcagccgatatctgcacgcccttcgggtttcccgtgctgccggacgtgtaaataatgtaaaatgtgtccagctcttttacccagttctcacggctgaggtctgcatctccgtcagctgcaagctcttcgggcgtaacggttttaatcagattgcttcccgtatcgactgcatcgcccgatacgctgataagcagctctgcgcctgagctttcaatgattttgacgatccgctccgccggaatggaaacatcgacagggatgtaagggcggcccgctttgacgcttcctaagaaagaaacgatcatattcggctccatatgtccgtaaaccaggacaggcgctttcgaaccgtcagctgtatgtttttgaatgccggacgcaacccgctccgacaaatcccataattccccgtaagtgagggaatgatctaaggaacgaaacgcttcggcctgcggcttggcgtctgcgtatgtttttatagcatcaagtagtttcatagttatcctccccgattagaaatcgttgtaaatataagtgccggtattcgctgtatgaaatccatacatccaaaagagcaatactaatatcagaaaataaaagcccgtatgaaacgtccatttgatcaatgtattttcataagcacgttttaatttttgcatcatattcaaaattccttccccgcgtattcaataattacaccagtatatgacgattagattaacaaaaagtttcaaaatatgtctaatatcctaagcttaaaatttccttaaaaatgaatgagaaacaaaaggatggaaaacacgcatgtataaattggcaaatgatcatactaaaaaagcgctgttcaggcgggatttttaacttatcgtaaatataaacgaggtaaaaaaattttggcggctttttcttaagcaggcttgtgccgaaccccaatggagaagggcgaaaagccgtttccggcaggatagctgataaagcgccgcatcttgtgaaatgaggaagaaattattatgatagataaggtagcagaaaacgtgaaaaccccaattcaacactactgttatcggctgactgtgaaagccttttaatagaaaggaagaggaaaatgaatcaaaacaatatggggggcagccaaaagacgcccgagaaagaaagcatgggccgcattttgtggcagctaacccgccctcatacattgacggcatcgtttgtgcccgtacttctcggcaccgtattggcgatgttttacgtaaaggttgatttcctgctgtttttggccatgctgttttcctgcctttggatccagatcgccacgaacttattcaatgaatattacgattttaaacgcggtttagatacggaggattccgtcggtatcggcggagcgatcgtccgccacggcatgaagccgaaaacaattctgcagctggcgctcggctcttatgcgattgccctcgtgctcggtgtttatatctgcatgagcagcagctggtggcttgcggctatcggccttgccggcatgctgatcggctatctgtatacgggcggcccgctgccgattgcgtatacaccgttcggggaactgttctccggcatttgcatgggttctgtatttgtccttatttctttcttcattcagacaggcagaattaatgaacagagcattttgatttccatcccgatagccatcctggtcggagcgattaacctgtccaacaatatccgtgatattgaggaagataaaaaaggcggacgtaaaacgctggccattttgatggggcatagaggggccgttatgatactggccgcatcttttgccatcgcttacatctggatcgtcggtcttgtcattatgggttacacaagcccgtggctgttcctggtctttttgagcgtgccgaaacccgttcaggccgtgaagggctttgtgaaaaacgaaatgccgatgaacatgattattgcgatgaaatcaacggcgcaaaccaatacattcttcggattcctgctttcaatcggactcctgatcagttatttccgctgatcaaatgaaagggcaaatgccataaccggcatttgctttttttttatgacataatcttcacgatattgtaaagaacctgaccgcggactgacccgtctcatatatggacagcaaagcaaggagatgaaaaaaatggacttgtcaacagcccatatggatgatttaaaaacggtcatggaagattggaaaaatgaattattagtttataaattcgctttagatgagctggatacgaagttttctatcatcagccaggaatataatctgattcacgggcataacccgatcgagcatacaaaatcacgcgtgaaaagttttgaaagcatcgtcaataaactgatgcgaaaaggctgcgatgtgacgacgcaggaaatgaaagagcatattcatgatatcgcgggtgtcaggattatctgttcctttatttccgatatttataatgtcgctgaggttttgaagcagcataaggatctgaagatcgtaaaggtgaaggattatatcaaacatccgaagccgaacggctaccgcagcctgcatttgattattgaaattcccgtttatttgacgaatcgtgtggaatatgtgaaggcggaaattcaaatccgcaccatcgccatggatttttgggcgagtcttgaacataaaatttattacaaattaaataacgaagtcccaaagcatctgaccgacgagctgaaggaagcagcggacatcgcccattatttagacgaaaagatgcttgggattaagaaagaagtcgattaaacgattgacgcatcacaaacagccggaccgcttttatgtgcagtccggctggttgtttttatgtttaggtgttttcgctttcccgcgcgatgtattctgacgatgattcaggctgaaatcctgattgaatttgaatagagaatgcaatagatatcaaatcgcaaacagcacattccctcagaaaaaatgtgtaagatcgaggtttactttttaaaaaaagggaaagacatttgtacaacaaaaagggagatgaatatcagtgggaaagaatgaaacaatgcatatcgtatcatgtgccgatgatcattatgctcgtcatttgggtgggatgttcgcttctttattgatgaatatggataaaacaagggatgcgaaattatatgtgatcgacggcggaattacttccgaaaacaaggacaagcttgaacagaccgcgatgtcattcgggacgccgcttgaatttttagaagtagacgctgatcaatacaagcatgcagtcgaaagcagccacattacaaaagcggcttattaccgcatttccatccctgatttaattaaggatgagtccgtaaagcggatgatttacattgattgcgatgcaattgtgatggaagatatttcggttttatgggacttggatatttccccggcaatagttgcggcggtagaagacgccggacagcatgaaagactgaaaaaaatgaatatcagcgacactgccaagtattttaattccggcattatgattatagatttcgaaccttggagaaaacaaaatatttccaaaaaggtgattgattttatcaacgaaaacagctcggaggattttctcgtgttccatgatcaggacgcgcttaacgcgatcttatatgatcaatggcatgaactgcatccgcggtggaacgcgcagacgcatattatcatgaatgagaaaacgcctcctgaactgatcgaccgtatacgttacagagaaacacgtgccgaaccggccatcgtccatttctgcggcagcgacaagccttggaatacaggcacctcgcacccgtatcgtgatcattatttccgatatatgtcctttacgaaatggaacacgattgaccgcccggccatgaaccaataggcaggtgtgatgaaaacgcttgtgaagccgctatccggctctcaagcgttttttttattatttcacccgaatcgcacgcacgcgtttttgcagactggtcttttcggcagacggcttcaaccggctgactgccgtttgcgccgctgattttgcttttttcgtcttggttttttcagccgcttttactttgtctctagcctgctgccggttgagtttatcttttatccggtcaagccgtttttccagagcggttttttcttttcccagctggatttcgctgacggctttttgggcttttgcggtgctggcctcagaggtctttttttccgcctgcttgacgctggcctcagctgttttcaaaaggcttgagttgacagcgttcagccgtttttgcagcccttttttctctgaaccggccggtaatttgcgaatggcgctttgtgcggcattgacggcggtttttttcttttgtttttcggcagtccggaccttgtctcttgcgtccgtcacatttcttgccgtctggactttattgatccgcgcctcgagagcggtttttccctttgacttggacagcttgctgactgccgtttttgcttgattgatatctgcctgttttttcgtcttttccgcttttattacggcccgttcggcgaaactcttttgctttacgggatattgtactaggccgtacccgaatcggctgtcacgtccgggagcgcccagatctttgatgttttgctgcatctgctgccggagctgtgtatttgtttcctcgggatatttctgcctgagcagcgcgaacatgccggtgacgtggggcgcggcttgagatgtgccgtcagccgtggcgtacatttgatttagatacgtgctcgtaatattggtgccgggtgcggcaaattcaatttgttttccggtcgtggaaaaagccgcgagcccgtttttttcagttgacgctgagactgccgttacgctgctgtaggcacccggataattgacgggttttttgttgccgtcgtttcctgcggctgctacgatcacgattccttttttgtatgctttgtctacggcgtcgtgaagaattttgctgtctgcgttagttccgaggctcatattgatgatgtccattttgttggcgatcgaccagtcgatcgctttaagaaggcttttaagatcgcctgcaccctttctgtctaatgccttaaccgcatataaccggacatccggcgcgatgccgtcaatgccgtatccgtcatgtttggccgcaatgattccggcgacatgcgtcccgtgtccgttgtcatctttgtatgagaagtatagctgactgcggaatagcctccggcaatggaaaggtcatcatgagggtaaatgccgctgtcaatgacagccactttcaccttttttcccgtcaagccttctttccacgcctgcttgacctgagtcggttctatatcccattgcggcagcgcgtaactgctgctttgggccgctgataacgggcggatatcagaaccgcctgctgcctgaaaggatacattgtcttctacatataagatgtcagggtcctgtttcaggtctttcaccgtttgtgaatcggctgacacggcgactgccgggagatgctgataggtctgttccacatccgctccgctgtctatggcggattccttgccgttttgatttttgtacaccacgataacgtcccggtcgtgcgtctcggcgtgcgcgggcgccgcggcggagaacaggctgacgcacaaggccgcggccattatcggtttcaggatgtgatacattgcaattccccctttttctttatatatcggcagtgcggaattctttttttcctgagggataaggaaaatttctgtatgcaaatgtaagcgtttccaaaatatgatggagaaaatgctttaagacatctgcgcaatgaactcaaaaagggggtttttgataaatgagtacgttcaatcgggtcatggaagaaaaaatcatgcctgtcgccggaaaagtcgccggccaaaggcacttaagagctttgcgggacggcattattttgactatgccgcttatcatcatcggatcggtttttctgattctgacgagtcttccgattcccggttatgccgattttatggctggtcttttcggtgaaaattgggttgaaaagctcgggtatcccgtgaatgcgtcctttgacattatggcgcttgtcgccgcctttgggattgcttaccggcttgcggaaagctatgaggtggatgccctgtcgtcgggagccattgcccttgccgcctttttattggcgacgccgtatcagattccgtttattcctgacggctcggcaacagagattatggtgggaggcggcattccgatttcgctgctcggaagcaaaggtctgtttgtcgcgatgatcattgcaatgctgtcaacggaagtgtaccggtttatcatacaaagaaatatcgttattaagatgcctgacggagtgccgcctgcggtcagcaaatcgttcgttgcgctcatccccggtttcattattattacgcttgtatggctggcccgtctgtttattgaaataactccttttaaaagcctccacaatgtcgtaggcgatctgctgggcaccccgctgtctattttgggcgggagtctcggcggaagtcttatcgccgaattcgtgcaaatgctgctttggtcgtgcggcatacacggcgcgtccattatcggcggcgtcatgtcgccgatctggtacggggcgatggatgccaaccgtttggcttttcaggcgggagaagcgctgccgagcatttttacgacacagttctttcaaatatggattaatgtcggcggaagcggagcgacgcttgcccttgtgctgaccatgcttgtgcgctccagaagcaaacagatgaaacagctcggccgtctcggcatcgggcccgcgatttttaacattaacgaaccgattattttcgggatgccgctcgtcatgaatccgctgttaatcgtgccctttatcattgcgccgctcttgaccattacggcgacgtacatcgggatgagcacggggatggtggcaaaaccggcgggaatcgccgtgccgtggacgatgccgccgctgatttccggttatttggcgacgggcgggaaaatctccggttcggtcatgcagctgatcaatctcctgattacatttatcatctattatccgtttttccgaatttgggatcttcaaaaatggagagaggaacgggcggcggaacaaaacgtcactgaagaaacataaaaaaaaacgggcgccttcgcccgttttttttaacgctggaaaaattcgatccattcgccgtcaggtccttcaatgtaaaagtagcgatatccgttcggaagcgtcgtgatttcctcatcgataaatacggcgccctgacgcttcgcatgcgtgaactccaccgcgatatcttcagtcaataaagcgacatggtgaacttttccttctgcgggaagctcgctgctgtagccctggatcagctcaatttccgtctccggcccttcttgaaagccgagaaaggcaagttcaataatgccgttcgtatgagtgatacgatcctttaacgtcataccgagaacgtcttggtaaaaggcgatggatgtttcaatatctttgaccataatgcctgtatggtcgattcttttggctgtcatgattttccccctgttttgaatttttcgggacaatgcggtgttgatcatgttttatggtacgataagagaaagcaaaacgaaagaggaatgcacaatgaagctacttacagtgaaagatacatttgccggaaagctgaaaaaaggattccccctgattgaaaaagacgctctgtccggaagctcggctcatttaacagagggcgatctttttgatgtgacatccgagaagggtgagtttatcggaaaaggctattacggtttgcagaataaaggagtcggctgggtgctgtcccgcgcgagagatgaacggatcgacggacgtttctttctggacaagctgaaaaaagcggctgaagcaagagcccatctgtttaaggcgcccgatacgacggcgttccggcttttcaacggtgagggcgacggcatcggcggcgtcacgattgacttttatgacggttatctgctgattcaatggtacagtaaaggcatttacgcttataaggacagcatgattgaggcgattgacggactggagctttcttataaagcgatctatgaaaagaaacgattcgatacggccgggcaatacgtggaagacgacgattttgtcaaaggcgaaagaggagattttccggtcattgttcaagaaaacggcatacagtacgcggtggatttaaacgatggggcgatgacgggcattttcttagaccagcgtcatgtgcgcaaagcgattcgggataagtatgcaaacggcagacgggtgctgaatacgttctcttatacgggggcattttccatcgcggcggcgcttggcggagctgagaaaacgaccagcgtcgatgtcgccaaccgcagtctcgcaaaaacgattgaacagttcagcgccaacggaattgattatgaggcgcatgacattaaggtcatggatgttttcaaatacttcggctatgcggcgaaaaaagggctggagtttgacctcatcatccttgatccgccttctttcgcccgcacaaaaaaacggacgttcagcgcggcgaaagattataaaaacctgctgaaggaaacgatcgccatcactgcaaaaaacggcatcatcatcgcttcgacaaacagcagcgccttcaatatgaagaaatttaaaggctttatagagaccgcctttaaagaaacaaatgagcgttacgacattttggaagaatatacgcttccggaagatttcaaaacgattcccgcgtttaaagaagggaattatttgaaggttgttttcttgcggaaaaaataggatgatcatttatagcgtggaaagaggggaaaagaaaaccctcttccatcgctttaatacgggataaaataatcttcatatcttactgtttaaagaaacaacccgctattacttagtatctcatctgtgccaagtaaagtggcctcactaatgcccacattgttggttttcatgaaggattgcaccgcttggtagccaaccgcataacctgcaaacggtgataagccgacaggctgataaccttgttcggctgcaaaggtgtcaccaaacatgtaactgctgacctcagcaaaccctttcacatttaatgagtctttgataatttcttttgagtattctaagtcttctttttcaaaagaagtaacccagggacctaacagagcttctccgtaaagttctttggcaaacgattctgccaacccctctatcattaagtaatcaccaaccgttacgttcccataatcccaattgaaatacgaaaaacgaatattatgatgaaattcatgtgcgattacagcaggcagtctcggtatgttataagaattggggaatattgaaacttgaataaatcccggaattcctccgaatccacaataccctctatgtaactcaagcttttttggattggccagatacatcccaaaccttatttcatcagcatttatttttaagcggttttgttggataaattctacacaatgagttaaagtgccatatgcaatttgaagagcttgaatttcttttagattctctaatgcttttcttccggtttccgtatcaaatatgctcagatagcccagcatatttgtagccatgattacatcatatccgttaggttgctttgcctttaagggaacattcatctttttccacatatcttcaaaaggtttcatcattgaataccgataataatcttctctattttcaatcattgaaaataacgtttcgtattgcccaattgtatcctcgataatgattttaatgggtaccaccctttttttgatgatctatataaattgtaatggcatcactcatgagcttcgccaacccttcaccatactgatcgatgttcttagtgaagcgtttatcttcaatatagagttgacctaatccgtaaaaggcatcaaaagaatattcaccaaaattttcattgagaaaatcaaaccactctttgatagctgtttgtacgtctggggacttgggagattggttaataaggagtgcaaatttattgaacattgcagtccacttatcagataaatctttttgctcaccatcagtcatgtttttcaatcttatatttacctcatcgacgggttgatcgccccaccgtttgcgagcttcttgttcataaagattatgcttaaagtgaataccttcaaacctctctttgtttgtcatggagatttctcccttgatatgtttgattgatttatctatctatggtttcaatcatcttgtctactctatttcgtttctcaatcaacattttcttttgtaatagtaatgcctcccttcggttaaatgaaggactattaatgatttctttaatctcttttaaggaaaaatcgagctccttgaaaaataatatctgttgcagctgttcaagattctcttcagaataaagccgataaccggaatcggtcgtttcctgaggagtcaataatccgatttgatcgtaatgatggagagtctgtatgcttactccaatcagttcagctacttcttttactttcatacccatcacgtttgccgcctccttaatggctactctaaagtattacgcagcgtaagagtcaatagttggataaagattttttgtatataaagggagaacatatgaggatttcattgctgaaattaaagaaaaaaagccgggcgtgaagctccggcttttttctattcaataatgtgctgcacccggccgattcgtccgtcttcaaggcggaccttaatgccgcgcgggtggaagcttgagttcgtcaaaatatctttcacgattcctcttgtcagctttcctgaacgctgatcggctttcaggacgatatcgacttcaagtccttttctgatgctgcttcgctgctggccgttcatatgacacatccgttcttcagtcttttcacttcatatcttatcatatcgtgttttcgtctttttatgaaggacagacaaatccatctgagtggcaaataaaaaaagaccgctctgtaaggagcagtcttttatgacataaacgaaagcaaaatcggggccgcgcacagcgtcataattgcggcgagaatcatggacacgcttgagatcgttcctgatacggagctgagctcaaatgctttagatgttcccgctccgtgcgcgctagttccgagcagcacgccccgggcaatttcgttatcaatgcggaaatagcggatgacccggtccgatgatcctagagtaaacacctctttatatagaaaaaagaaataagtctgataaaaatagaaaaaaacttgattaaatacattttttttgtatacaatccttatatatcaaaaaaaggaggatcaatagtgaaattcaaaaaagtacttacatattctttcggaacgattgttcttttgtcaggtttagttacaactaatgctttggcaaaaggagacacaaaagatacaggttattatctcgagatgccaaaaggatttggtgccaataactatacagggtctagaactaaatacaatgattcctcagtatatcaaaaaaactcatggataggtagagacagaaaaataaatttgtggatagttaataaagataaaaaggatgtatcaggcggtcgttacgtagttgttagtagtggtcaacataagaatataccaaatgttgcaattgagaagaatcatggtaaagcactcggtgtaagaattgctggagaggtacaaggccctccaaatgcagtagttattgcagcaaaaggagtttggagtccagatagtagaagatagaatttgataataactagaaagaattttttctttctagttatttgaattgggagggttttttttgttttatcaattattgaaaaataatttcatagaagttttaagctcgaaaaaatataaattttctttattaattatgattctccttttcgttattgatattttcatatcaatctatcaaaagttttctcttccttattttgataaagatcatttgagtttttcgttgtatttttggttaggcacgaacgactctgttattagcggtatcttaatattcttatttgttttaatttcttgcttaccgtacagtacaaatgtattagaagaaaagcaaaatggttattttcaatttgttatatcacgttgttcattattaaaatattttagttccaaagtgataacagcctttattagcggcggtttcttatttgttctcccttttgtgttatcattcatattgatgttaataatgttcggaaacaagttgccgtatactgaatttgttgataattatggaatgtttcatcagattgcagagtatcatcctagtatttacatggcaatatatattttaattttgttttactatgcagggtcttttgcaattttaggagtgtttttgtctactttcctaaagaataaatatcttgcatatgtgtcaccgtttttgattattttggttttagaacctgttttcgaaatattttacccacagttatcgcctatattgttaatgagtcccattcaaactattacaggtatttcgattatatatctgtttgcgataccatcttttgttttagcaatttcattagtaggaacttatattgggttgaaaagatatgttcaacaataactttctgtattatttactgaaaataagttacaaaagaattttattaacatttataattttgctgttgttaaattcggccgtattttataataatacaattaattcagcaatagatattagttttatgaaaattttcttgaacatattaggtggacctacaagctttataacagtatgtgtatttttattgtctttgaatagtttgcatttttcaaattatgttataccacggtttaataagagaactattttttttagttttattattaagcttatcctattaaggactattttgtttttagtattagcagtattaagcactttacttacagcgttacttttatcacctggtacatttcttaaaactataatttatacaaatgggactattggattgcaactagtatgtttgttattagggtgggtaatggttttattaattattcagttagttatattgatattcgaattgaagtttccaagatacggaatgttaattggttcggttattgtactactaatcctatttaatgatatgtatgattatttttcaatcatatttgttcaggccatatcatccacgttttacgataaattatatctattatttataattgtttttacatccttgatttgcttgaaactatcaaagtcttttcaaatactgaggagataaataaaaaatgtatttatatgatgtgaaaaatatctggagacagaataaatggcaatggataatttggatttttgttattgcttttttgctatttatgatagtccatagtctcaatataattaatattaattctgtttgggagtcgttgatgggaaatgaattatttttcatgccgttcccttatttctttatctgtggattttacttgttgattaatggtaattatttatatcaacaacggagtaaaacaatttctattgtccttactagagtatcctcgaggaaacaatggttatttggcaaactcttttttactatagtaatgtgtactagttattgtctgttgttaattttattagtacatatagctgtttttttaaaacatggaaattttagatatgaccattatacagcttatactttttttacagtttttttaactttgttaatttgtggtttgtttcaaaccatttatattttgaaagtaaaacctatacaagctttttttgtagtgtatggtctattgatacttcctgtatggattgacgtaccttttttacctggttactactcttttattagcaatactcttataactccgcatgaagttaatcatagtggttatttgtttttctttactataataacaatttgtttaattatgcttgcaattaagcaaattagacacaaaaactttttttaaagggagaacaatatgtctttaacaataaagttagaccatgtcactaaaacacttaattccaataaggtagtaaatgatgtttcgctacagttattttcaggaaaggtttacggatttaaaggtgtgaacggttcggggaaatcgatgcttttcagagtgatttctgggctactcgttcctgaaaagggtgttataactgtgaaccaaagcattttacataaggatatatcgtttccagagagcatggggatagttattgaaaatccggaatttattcctcacttaacgggcaaacagaatttaaaagtgcttgcatcaataaaaaagaaagcgacggacgcagatattaataaagcattagacatagttggtttggataaaaatgattcaagaaagtataagaagttctcactaggaatgaagcaacgtctagctattggacaagctattatggaaaatccggatttgctaatccttgatgagccaactaatgcattggatgaagaaacacttcataaaataaagacttttttgatcgactataaaaaaagaaacaagttaattcttatttcaagtcacgataaaaactttcttgaatcaattagtgatgaaatatttgaagtgaaggatggaggtgtaattgtttcaatgtaatagctattaaaattgagtttactaaaaacaccatttcttaagagaaatggtgtttttaatttaaatatagtgaagttaatgagggttaaaaaaacgaaagcaaaatcggggccgcgcacagtgtcataatcgcggcgagaatcatggacacgcttgagatcgttcctgatacggagctgagctcaaatgctttagatgttcccgctccgtgcgcgctggttccgagcagcacgccccgggcaatttcgttatcaatgcggaaatagcggatgaccatcggcccgatgatcgttcccaataaagccgttaaaatgacgaaaaccgctgtaacggccggcatcccgccgatcatttctgaaacgttcatggcaatcggcgtcgtcacggatcgcggcacgagactgtcgactaagctgctgccgagatggaaccatttggcgataaaggccgttgacagaatggcgatacatgaaccgaccgctacgttcaaaataatttccacggcgtatttctttaaaatcgggaaatatttataaagcgggatggcgaacgccactgttgccggctgaagcatatcggtcagcagtccgccgccgagattgtatgtctgatacgggacattgacaagaagcagcagtacgaccaaaacagcgggcgtaatcagaagcggcgacgtatacacccgcggaaaacgagtgtagagttttttcgcgcccaaatatactaagacagttaagaataaacttatgattccgatgaacacgtttgttttttctcctttctttttgctatcagctgtgtaagcgtacctgttgaaaccatcacgacaaatgtgctgatgacgacgacaagtaaaatgcttacgccgaatttagacataatatctccgtattcaatcactccgacggcagacgggatgaaaaacagcagcagctcaccgaggagccatgctgcgccaagctcaatccattcaagtttgataatcttgaaatgcaataatgtgaaaagaatcacaatcccgattatactgccgggaatatttatatgaagagccgccgtgacccaattgatcagacgcgcaaatataaacagcagagcgatttgaataacggtaagcagcaattttttcataatgatgcctcccttatatttatattgtacagaaggttttcctataggtaaaatacatataaagaataatgtgtattccttttgtctatagaaaggatgaaatgtaatggatatccggcacttaacgtattttttggaagtggcccgtttgaaaagctttacgaaggcttcacagtcgctgtatgtttcacagccgacaatctcaaaaatgattaaaaacctggagacggagctcggcattaagctgttttaccgcaatggccggcaagttgaactgactgacgccgggcagagcatgtatgtgcaggcgcaggaaatcacaaagtcattccaaaacctgacttcagagctgaatgatattatggaagtgaagaaagggcacgtccgcatcggtcttccgccgatgatcgggtccggctttttcccgagagtgctcggtgacttccgcgtcacatatcccgatgtgacgtttcagcttgttgaggacggctctattaaagtgcagcaaggggtggaggacggctcgcttgatatcggggtcgtcgtgcttcccgcgaatgaagaaatttttcatacgttcacaatcgtcaaggaaacccttatgctcgtcgtccatccgtcacatcggctcgctgacgagaaagaatgcagtcttcacgaattgaaagaagagccgttcatatttttcagggaggattttgtccttcataatcgaattatgacggaatgcgtgaaagccggattcaggccgcacgtcatttatgaaacgtcacagtgggactttatcagcgaaatggtatcggccaatctcggtatcggccttttgccggaaagaatctgccgcggtcttgatcctgacaaagtcagaaccattccgctcgttcatccggtcattccgtggcatttagcaatcatttggcggaaagaccgctatatgtcctttgccgccagagcctggctggagcatacgaaatcgtatttatggaatccgaaaaagagaaaaaaggatgattaagcatggacgcacaaaccgcagctcaacacttgagtaaagtgcgggatcaaaacccgctcgttcacagtatcaccaataatgtcgtcacgaacttcaccgctaacggactgctcgcgctcggcgcatcgcccgttatggcttatgcaattgaggaggccgccgacatggcgaaaatcgcaggagcgctcgtcctgaatataggcaccctcagttcggcgtcggttgaagctatgatcgcagccggaaaatcggccaatgaaaacggtgttccggtcatttttgatccggtaggcgccggcgccacgccgtttcggacggcatcagcccgcaagatcatacaggaggtccgcttgtccgtcattcgcggaaatgccgcggaaatcgccaatattgccggcgcccctgattggaagataaaaggcgtggatgcgggggaagccggaggagatgcggttcagctcgctaagacggctgcaagcaggctgaagacggtcattgcgattaccggaaaaaccgacgtcatctccgacggcaccgacacatacgccgtacataacggtgataaactgctgacgaaggtgacgggggcgggatgcctgctgacgtctgtaatcggagccttctgcgcagcggggcaggacgttctgcaagcggccgtttcagccgtttctgtatacggaagcgccgctcagcttgccgctttggacacctcccataaggggccgggcagcttccagattgagcttttaaacaagctggcaagcatctcagaacaagaagcggccgagcttgccgcaattgaaagggtgatagaaaaatgacgcgtatttctcgggaaatgatgaaggatatgttatcggtttattttattatgggatcaaacaatacaagcgcagacccggtttccgtggtgaaaaaagcaattgagggcggcgctacgctttttcaatttcgggaaaaggggagcggttctttaacaggggatgaacgtgtcctgttcgcgaagcgggtgcaggatgtctgcaggcaggccgggattcctttcatcattaatgatgatgtcgaattggccttgcgccttgaggcggacggagtgcatatcggacaggatgacgcagacgccgaagaaacgagagcggcaatcggcgatatgattctcggtgtgtcagcacataacgtctccgaggtgaagcgggcggaagaagccggagccgattacgtcggaatgggcccggtctatccgaccgaaacaaaaaaagatgctgaagccgtgcagggcgttacattgattgaagaggtacggcgtcagggcatcaccattccgattgtaggaatcggcggcattacggctgacaacgcggcgcccgtcattgaagcgggtgcagacggcgtcagcatgatcagcgccatcagccaagccgaagatccaaaagcggcggcgcggaagttttcagagggaattcggcgctccaaagcagggctgtcccgatagggcggccctttttctgtgtgcgcaaaaaggcagtgacggacttggagaatataagccgtatgtcaagaacagagcaatcagcttgcaatatcgaccgaagcgtttgacggctctatcgcttctctcaaagtgacgcctgaaccaatcaccgccggcgccgaaggctcaaaagccctctataaaacagtgaatagcgcgcagtgagagtcacggaaaacttaatgcggaattcagcgaatttgaagttttgatgtcgaaatacaaaacgtgcgatcaatcgtatacgtcttgtgatacattaagtacagatcaaatcagagagataagcacgaaactgacggctctttctgaaaccatgtcgaagattgccgatgtgctttaaaaggagttaagacacagcatgagcgatgaacataacaaggaaaaacagatccacagacgggatgtcctgaagtggggcgccgtcgcgggcgcagccgtcgctatcggagcgagcggcctcgggggactcgcgccgctcttcaaaccggcggccaccgcttcaaagaagaatgatgaaaaacatgatcgtgatcaaatcgttcctttttacggaaagcaccaagcaggaatcacaacggcgcatcagacgtatgtgtattttgcggcgcttgatgtcatgtcaagcgacaaagccgatgtcatctcccttttcaaacaatggacaagcctgacacagctgctgacttcaggcgccgtcccgtcaggcgaacagaaaaataaatatatgcctccgcaggataccggggagtcgcaggatctggcaccggcgaatttgaccgttaccttcggcttcggccccgggtttttcgagaaagacgggaaggaccgcttcggactgaaagataaaaaaccgaagcacctcgccgatattccgccgatgcctaacgacaagctcgataagaaacaaggcggcggtgatatcgtcatacaggtctgcgcggataatgaacaaacggcgtttcacgcggtgcgcaacctgatgaaacaggcatcgggtgtgtgtgaagtccgctttcttaataaaggtttcttaagcggcggaaaaaacggagaaacaccgcgcaacctcttcggattcaaagacggcaccggcaaccaaagcacgaaggatgaaaacctgatgaattcgatcgtttgggttcaatcaggagagccggactggatgacgggcggcacgtacatggcgtttaggaaaattaagatgtttttagatatatgggaccgttcatccttgaaggaacaagaggacacgttcgggcgggtgaaaagctcgggcgcgcctttcggacaaaaaaaggaaaccgatcccgtgaagctgaatcaaattcccgccgactcgcatgtcagcgtggcaaaatcaaccggcagacagatcctgcgccgggcattttcctatacggacggaattgatccgaagacaggctatgttgacgcaggcctgctgtttatctgctttcaaaaagacccggaccgccaatttgtcccgatgctgaaggctttggcggcaaaggatgcgctgaatgaatacacacaaacgatcggctcttccttattcgcctgtcccggcggctgtaaaaaaggagaatatatcgcccaaaggctgctggaatcgtgacaccttccatatggagggtgtttttttaaaaaaacacttgtaactataaaagttacaacttaaaatgataaggaaaggagacttacaatgacactgcagattaaagtatattcggattatgtatgtccgttttgctatgtcggcaaaacggcgtttgaagaagctatcaaagacaaggacgtacaggtggaatggatgccgtttgaattgcgtccgagcccctcgccgaaacttgatccggtgaatgatcccgccaagcggcagatgtggaaaaactccattgagccgatggcgcagtcgttaggcgttgaaatcacgttcccccgcgtgtcaccgcatccttacacggatttggcatttgaaggctttcatttcgcaaaggaacatgggaaaggaagcgaataccatacacgcgtttttcaggcgttctttcaggaagaacaaaatatcggtgacgttggcgtgctgacaaagcttgcggaagaagcaggacttgacggtgctgccttcaaagaggcgcttgagacaagagcgtacagacacgtacagcaggaagcgctccgccatgcttatgaggaagccggcattacggcagtgccgacgtttatcatcggcgatgagagaatccctggcgcggcgggaaaggaaacctttgaacaaatcattgagcgggaactgaataaacgttaacccgaaaaaagccctctcgatcagcgagagggttttgccatatagtgtttgacaaatgtttgtctgtccgcttcatatgccgcggcgtcaaaggagtcgccgcaaaaatgaaggcaccaagggtctttctggcaggcgacgccgacttgatagccgtgtttttgaaattcgagcgactgtgatgtgtcgtaaaaatgaaagccgcgaaacaaatcctcccgccactccacgtcatattgagccgccattaacaagccgtcaatggcgtcagcgggcgtaaacaggccgtcttcatcaccgtgctcaaaatccagcgggtgataagcattcccccggtattcaatcacttttcccatccgctgtccgctttcccaccaaatgccgttcggcggcaaggttttgcagccggcgacaccgagaaggccgagctcctgatgagattgaaagatatgaagcatgtcatgaaggatatgctgatgaatgataaaagtatcctgatgcagataaattttatatttggaggggtgtttcagcgctttgttgtaggacgaggccatgcttgctgaatcgtatatcggcatgatatcaacggagtatgaaggggggacggtaagctgcatgatatggctcttgcaccgggagtacagcgactcatcattcacacagacgacaaacagaaatgaatgtgaatccattacatgctcctctcggcctcaatcacatattgataggccgatgcttctgtcataaagtcatgccttatgccaagctgtacgcatacttcgtgcaatgatgcgatggctttgtggtaagaagggtgatcaacgcggatcgcctcaatgcgtttcacctcatagccggcggctttaaataatgaaagcgtctcttcccgggtaaaaaaacgcaggtgggtctgatccattaatccggcgtcactgtaagtccatttgccggctaaaagctccagcacgactgagatgtggccgacattcggtatgcatgcaagcaccgtgccgtctttttttacataaggacgaagctttttcagcactgaccacgggtcgacaagatgctccagaacgtctccgaacagcatgcagtcgaattgctctgattcgtacggaagaatggcggattcaatgtcgccgcaaagcacgtggctcaatttgctttccgccttttttgcggcttcgggatacgcttcaatgccgtaaaccgttattccgcggtcttcgatcgccgctcctaaattgcctgtgccgcagccgacatcaagcactgtccgccagttttcgtctattttgttcaataaataaggattcaggccttcgtagtagttctgttgtttttcatcataatagggattcgtatccatctgtgtatcacctcataaatgggcatatacacaagatatgcagcggggggatctcatatcaccatgtttggctgttcaattgcggaatacggacgggaatggttgtccggtatacggtttgttctctgattcccctcttattgcggatgttcctttgaaaactcgggtgcgggcggactgtggcaggtcatatagtaaaaggatccgcctgtaaatcttaccgctggcggatggtgtttttcattggtgtttttttcttcaccgctttttcagtatttaagaagcgcctcacatcgtcaatgtgcaaacccatgattctagcctcttgaattaacaattgccaatcttgatctatatctttcattacatgagttttcataagaacctccaattgaaaaattgatttgcccagctacagcagccaatgtataacaaatatcacacatagttggccggtaatcccaaattgaagatgaattcacctacctattccctaagaaaatgactgaaataaccaaaatccttcaagaattcttacatataataataaacaaataaatactgactggatagtatgcaaataaaaataaatcatatgacctattaacatataccctcaaagcgtcgactagcatattctttttgcataaaaaataccgcaaaagaatgattcggtgtaagataaagtgaatgatcaaacagctggggtaaaaaatgaaaaaaaacaaatttcaaattaagagagaagaaacatttgaaagttttattgacgcaggccttcatctcctgattgaaagagcttacgattcagtctcaatcgatgacatcagtaaagcggcgggtttcagcaaaggcgcgttttacgttcattttgaaagcaaggaagattttctgaagcatttattagacaggcgtcagattaaaaaaaggatcatcaccggctatctcgacgaattagaaaagcaaaccgcgcggccgttgacgctttgtgaagctgcggcaagcgcggccagcctgttgatgcggtttgtaaacagcaagcctgcctggaatgttgtgtcttttgccgttcatatgcctacttacaaagtcgtcagtgaatatgaagcttatatccgtctttataagttatggatagaagaaagcaccatgtacataaattggctcaaatcgagaaatttaatagaagaccatatagataccgagcataccgctaaaatgatgtgcgcgctcatcgacgggatgattaagcaatccaatgtgctgggaaggccggttactttccgcagcatgtttgacgcgctttatgtttttgtcagcggcagaaaatcagggtaacgttcttcttgatttgacaaaaggtttagaaaagtctttcagaaagcgaggaactgccatgcgttacagagaaattatgatgtatatcattatggggatattcacgaccatcgtgaatatcgtcagtttttactttctgacgtcggcatttgagatggattacaaggcggcgactgtcgctgcttgggttctgtccgttctatttgcatatgtcacgaataaactgtatgtatttcagcaaaagaccgcggggatgcggagtctgatgaaagaattgacggcctttttcagcgtgcgggtattgtctctcgccatcgatctcgccatgatgattcttctggtcagtcaatttcatatgaacgaaacgctggcgaaaatcgccgataacgtcattatcgtagtcgtcaactatgcggccagcaagtggattgtcttcagaaaagcgaaagaagagggcgtgtcataacggtttctttccgcgccccgggggaaagtgtaatggtgaaaggggatgcgtatgaagcacaaaataaagaaagcgtttgctgatgtattcggggaatcggaggacctgcgcattttctttgcgcccggcagagtgaatctcatcggagagcatacggattataacgggggccacgtctttccgtgcgcgctgacaatcggtacatatgcagctgtccgggagagaggggacaggctcgtcagaatgtactctcataattttaaagaagcgggcataaaggaatgcagtctcgatgatatccgctatcaaaaagaggacgggtgggccaattatccgaaaggggtcatggcggaatgtctcggcagcggtttttcccttccgcacggcttcgatattgtgttctggggaaacatcccgaacggcgcggggctgtcatcttcggcttccattgaacttgttacggcggtcattctcaaggaatgccatgagcttgaggcggatatgctcgacttggtgaagctcgctcagtcggcggaaaattcctttatcggcgtcagctgcggaatgatggatcaattcaccatcggaatgggaaagaaacatcatgcgattctgctgaattgcgggacgctcagttttgaatatacaaaactcgggctgtcggggctgtcgatcgttattgcaaataccaataaaaaacgaacgcttgcagactcaggctataatacgaggctcaaggagtgcggggaagcgctttgtgatcttcagaagcatctttccgttcaatcactgggagaactgaccccttccgcttttgacgcccatgcggagctgattcagaatgaagtgaacagacgccgggcaaaacacgccgtctatgaaaatcaccgcacaatagaggccgccgacatgttcagtaacaatcagcttcatcatatcggtgaattaatgagggattcgcatctctctttacgcgatgactgcgaggtgacgagtcatgagctggatacactggctgaagcggcctggcgccacggcggggtgatcggatcaaggatgacgggagccggtttcggcggctgtacagtcagtatcgtcaaggacgatgcggtttcggattttattgaaacggcaggggcccgctatgaggaaaagacagggagaaaagctgacttttacacggcgggtgtcggagccggagcgagagaactaaagggggatgacgatggcaattgagcggcacgtggaacgtttaatccggtacggattgcaaaaagagctgatttcatttcttgatattgaatatacaagaaaccgtttatacgaaactttgcatattacccatccggaggcttcagaacagaaagaaaatgaatcggcggcatcattgccggacatattggccccgatttatgaatgggcggcagaaacgggccggatggcagccgatacagacacctatcgcgacctgctgagcgcgaagatcatgggctgttttgccccgcagccgtccgagattgtccgtcgttttgaagaaacaaaggcggtgcacgggccggagcaggcgacaaaggcgttttaccaatttttagaggatgtgtattatatccgttcggacagaatacagcggaatgtcgggtggacggctgagacggcttacggaaagctggacatcacgatcaacctttcaaaaccggaaaaagatccgaaagcaattgccgctgccaaagagcagcctcaatccgattatccgagatgtgttctttgtaaagaaaatgtcgggtacgaggggagaccggatcacccggcgcgtcaaaaccttcgtgtcattccggtcattctcggcgatgagcagtggtttctgcaattttctccgtatgtgtattaccgggagcattgcatcgttttgaaagaccggcacgaaccgatgaagatcagcaaaaaaacgtttgacaggctgctgtcgtttgtcagccagtatcctcattattttctcggttccaatgctgatctgccgattgtcggcggcagtattttaagccacgaccattttcagggaggccattatgaattcccgatggcgcgggcggagacagaaagccggtacaggctgcctgactatccgaaaacggtgctgggaattgtgaagtggccgatgtcggtcatccgcctgcagagcgagagcgcgtctgagctttccggcgcggcggatgccatcctgcgggcgtggcgcggttattccgatgaggcggctgatctcctcgccttttcaggagaaacaccgcacaatacaattacgccgattgcccggcggagaaacggtttattcgaattagatctcgtcctcagaaataaccgcacctctgatgagcatccgctgggaatttttcatccccatcaggaagttcatcacctgaaaaaagaaaatatcggactgattgaggtaatggggcttgcgattctgccgggccgccttgaacaagaaatgaaatacacggctgaagcgctgtgctcaccggacccggaagcggtcttaacggcaggcccttctgcggcaaagcataaagattgggcgctcagtgtgctgcataagcggaagataacgaaagaaaacgcggaacagattctgaaagaggaaatcggccatgcctttgcgcggatactggagcatgccggtgtctttaaacagacagaagaaggcagagcggctttccggcggtttatccgccatttgggcgctctaccggaaaaaagcctcatcccataagggacgaggcttttttttatcctctgcttctggcgatcaggctgaataagaataccacgatcgcagctccgatgattgccggaatgatggcaaagccggcaaggtgaggaccccatgtgccgagcagtccgtgcccgatccatgcgccgatcagaccggcgatcattgacccgatgattcccccgggcatactgccttttacaaataaacttccgatccagccgataataatagcgacaatcagagatacgataaaacccataaatatcacttcctattttttattatttatgcctatatgtttccttcgttttgtccatattaaacatatgaatgcgttttttataatgaacatatcaaggcgcgttccggtcttttttttcacaatgcgttgcgttaaaatggaaaccgtgtgaaaaggtgtgagcaaaggaaaaaatatttcttttgtagaatgtttaacaaaatgaaactttttgttgaccagcgatttttattatggtaaacctttatttggtattattcgttctcactatcttttttctctatatatgctaaatgatctaaaactttttatgtttgatttgcgcaagtggaaaaagttcatgcattttttgacgattttgtgacattaggtcgaaaaaaagatgaactttagaaaaaaataaagctaataagggcagattttgatagcataacaaggtagatagagaaaagattttgagaaagtacatttcagattcactacatcaataggaaggatggtgatcttcttgttcagagcatttaaaccgttacttttattagcgatgttggctgttgttttcgtactgggcggatgcagcgacatttccgttttagatccgaaaggacctgtagcagaccagcagaaagatctgattctcttgtcaatcggatttatgctgttcattgtcggcgtcgtattcgtactatttacaatcattttagtgaaataccgcgaccgcaaaggcaaagacagcggaaattacaagcccgagatgcacggcaacacgttcttagaagtagtctggacagtgatcccaattttaattgttattgcactttctgtgcctaccgtacagacgatatattcgttagaaaaagcgcctgaagcgacaaaggataaagagcctcttgttgtttatgctacttcggtagactggaaatgggtattcagctacccagagcaggatattgagacggttaactacctgaacattcctgtagaccgtccggttttatttaaaatttcttcagccgattcaatggcatcgctatggattcctcagcttgggggacaaaaatacgcgatggcgggaatgctgatggatcaatacttacaggctgacaaagtgggaacatatgaaggccgcaacgcgaacttcaccggcgaacactttgccgaccagaaattcaacgtaaaagctgttacgcaaaaagactttaacagctgggtgaaaaaagcccaaagcgattctccaaagctgacgaaagagaagtatgacgaactgatgcttccggagaatgtcggaaaattaacgttctcttctacacacttaaaatacgttgaccacggccaagatgccgaatatgcgatggaggcgcgcaaacgccttggctacaaagccgtatcaccgcactctaaaacagatccgtgggaaaatgtaaagaaaaacgaatttaaagtatccgacgataaacaagattgaaattgaacaagaaaggaggaagcccgaatgaaattgagatgggatgaattttttgtaacaggtgacccattaattctgggcgcacaagtttccattgcgctttccactattgctatcatcgttgtactcacatacttcaaaaagtggaagtggctctggtctgaatggcttacgtctgtagaccataagaaacttggaatcatgtacattatctctgctgttatcatgctgttccgcggcggggtcgacggcttgatgatgcgcgcccagttagcgcttcctaataacagttttttagactcaaaccactataatgagatctttacgactcacggtacgatcatgattatcttcatggcgatgccgtttttaatcggtctgatcaacgttgtcgtacctttgcagatcggtgcgcgcgacgtagcattcccttacttgaacaacctgagtttctggacgttcttcgtaggtgcgatgcttttcaatatttctttcgttatcggaggttctccgaacgcaggctggacgagttacatgccgctggcaagcaacgacatgagtcccgggcctggtgagaacttctacctgctcggtcttcagattgccggtatcggtacgctgatgacgggtatcaactttatggtgacgatcctgaaaatgcgtacgaaaggcatgacgctgatgcgtatgccgatgttcacatggacgacgctgattacaatggttattatcgtattcgccttccctgttttgacagtggcattggcgctgttatcatttgaccgtttgttcggcgctcactttttcacgctggaagccggcggtatgccgatgctttgggctaacttgttctggatttggggacaccctgaagtatatatcgttatcttaccggcattcggtattttctctgaaattatttcagcgtttgcaagaaagcagttattcggttacaaagcgatggtcggctcaattatcgccatttccgtcctgagtttccttgtatggactcaccacttcttcacaatggggaacagtgcgtctgttaactctttcttctcgattacaacgatggcgatttcggttccgaccggggttaaaatctttaactggctctttacgatgtataaaggccgaatcagttttacaacaccgatgctgtgggcgcttgcgttcatcccgaacttcgttgtcggcggggtaacaggggttatgcttgcgatggctgcagcggattatcaataccataatacgtacttcctcgtatctcacttccactatgtgctgatcgcgggtacggtatttgcatgtttcgcaggatttattttctggtatccgaaaatgttcggccacaagctgaacgaaagaatcggaaaatggttcttctggatctttatgatcggatttaatgtatgtttcttccctcaatacttcttggggctgcaaggtatgcctcgccgtatttacacttacggaccgaatgacggatggactgcattgaactttatttcaactgtcggagccttcatgatgggtgtcggattcttaatcctttgctacaacatctactacagcttccgctactctactcgcgagatcagcggagattcatggggcgtgggacgtacgcttgagtgggcgacttcatctgcgattccgccgcattacaactttgcggtgcttcctgaagtgaaatctcaagatgcgttactgcaattgaaagaagacaaaacggatattcatccggaaagcaagttcaagaaaatccatatgccgcacaactccggaagaccgcttattatgtcagtggcgttcggtattgcaggcttcggacttgtatttgaatggttctggatgggcattgtcggcttgatcggcattctgctttgcatggtgcttcgttcatttgaatatgacaatggctactatatacctgttgaagaaataaaagagacggaaagaaagatttccgaataaaggaggcgtgatttatggaacatgcagaacacggcaattctaacgcgcctatggaatatcaatctgaaaccggcagactcaatattctcgggttttggatctttttaggggcagagattgtgttgttctcaacactatttgcaaccttcttcgttcttcaaagaagaacagcaggaggagtcttaccggctgaattatttgaagtgaagcttgtcatgatcatgacattcctgcttctgatcagcagtttcacctgcgggatcgctgttcatgaaatgcgtcgcggaagtttaaaaggcgtcgtcatttggacgatcattacgcttcttctcggcgcgggcttcgtcggatgtgagcttaacgagttcatccactatgtacatgaaggagcatctctcggtacaagtgctttctggtctggattcttcgtccttctgggaacgcacggaacgcacgtaacgatcggtatcttctggattgccggcatcttactgcaattgaagaaacgcggattaacgccgcagacgtcttcaaaaatctttatctcaagtttatactggcacttcttagacgttgtttggatcttcatctttacaggcgtctatctcatcggattggggggactataatatggcaaacaaatctgctgaacacagccactttccgtggaagcatatcgtaggttttgcgttgtctattattctgaccctgctggccctttgggttgcggtatatacggaattaagcccatcagcaaaactctggatcattttcggattcgcatttatccaagccggtcttcagcttctcatgttcatgcacatgacagaaagcgaaaacggcggaattcaagtcggaaacacgctcttcggatttttcggagcgattgttatcatccttggttccatctggatctttgcggcgcactaccatcacggtgaccatatggatggaaaccctcctggcggtgcgaagcaacattccgaacatcaggaataaaaagaaaccctcttcgtttatgcgaagagggttttttgtgcctttattggcttcttctccggcgcaggcgcggaaggccgtaaatgataaaggcggcgatatgggcaacgatgacgttggcggcaaacaggatgatcatgagtgtatggccgagaggggataggctgctggttgcgtaaaagtagaagaaaacccacatgagaataattggcggtatggccgaaagagccacttttttgttatccagccagataaagaggggtgttgcgcttgcgaccagtaaataagcaaaaaacatgtccatcttacgtgtctcctttcattttatgggagcgtttccaaaatgaaatacagagaataaaatgtgtctgttttgtggtcgttttttgaacattttgttacaattattataccatgttttccaatttttgataccgctttttcgagaaatgtattgcaactattgcttcatttttggataggtacaagaaaccggaaaggccaaataccctgtcacatttccggacaatggaatggcgcaggctgtgaacctttgctatggtcaaagaaacatgcacagcaagggtggtttgaagtggacgtaaggaaagaagatgtcacagcgccggatgtcattgcgcttttgcaggatcatctgaagagcatgaccatgcattcttctccggaaagtatacatgcgctcaatgcggaccggctgcgtcagcctgacgttacgttttggagtgcgagggaaaacggcattctgctcggctgcggtgccttaaagaagctaaacagccggcacggtgagatcaaatcaatgaaaacctctccgcatcatgtcagaaaaggcgcagccaaccggatcctccgccatatgcttgaagaagcaaggcggcggggctatcagcggatcagcttggaaaccggttctatggaggcttttctccccgccagacgcctgtatgaaaaagccgggttgtttcaatattgtgatccgtttgcacattataaagagaacccgaacagcttggttatgacgttaaacataagctgaaaccccttttctgacgagaaggggttttttatcggaaaagtttcatcatgaccgaaacatttccttttctgacacgtcatatgtcgtgtagtccccaaaccgtaaaaaataaaaaggaagcaacctcatcatgttttcttgaacggtgttcatgtataataaacaatagtgacttccgatgaaaatgtaaggcgggatagaatgagtcgatataagaaacagcaaaatccctattatcagggggatttgatttttatatttggtgtgtttttaataattagtgttgcggcgatttatgcggccggacagttcgggcagtacggaggcagtgcctggatgaaacagattgtcttctatgttataggtgcgggattcatcggattattgctgtactttgatttagagcagcttgaaaaactgagtctgtacgtattgattgccggcgtgctgtcgctgctccttttgcgtgtggcgccggaatccatcgcgccgattaaaaacggagcgaagagctggtttcaaatcggaaactttaccctccagccctctgagtttacgaaaataggaattatgatgatggtcgcgtccattatatcgaaggcgggcccgaaggatcaaagatcacttcgggaagatgtgaatctgctcttgaaaattgcggcatggacggtcattccgctcgggctgatcgttttgcaggatgccggaacgggtgcgatctgtctgtttatcgttatggtgatggtgtttatgtcgggtgtaaactggaagctgatcaccatcatcggcggttcggccgcgcttgtgcttggccttttcttagttctcgtgattgaatttccccatgtggcgaattcaatcggcattgcggattatcaaattaaccggattacatcgtggatgtctgactccagtgcggcaacgactcaggcagagagcgataaaagctggcaggtggatcaggccgttatggcgatcggatcgggcggcattaccggaaacggcgttcataatctgaaggtgtacgtacctgagggacagaccgactttatctttgcgattttgggtgaaagttttggatttttaggctgcgccattgcggttgtcatgtttttctttttaatttacagacttgtggtgctgattgaccgcttgcatgcgtttaaccgatttggcgcgtttttttgcgtaggatttactgcacttatcgtgattcacaccttccagaatatcgggatgaatatcggcattatgccggttaccggtattccgctgctgtttgtcagttatggggggagctcggtgctttctacattaatcagcttcgggatcgtatataacgcaagtgtgcagctgacgaaatataaaagctacttgttcaattcttaatgtgagacggctcgtttttcgggctgtctttttttgtttagagcatttcgcttttgacatgattccctttcggatatgatatataaagaaggaggcttttatatgaacaataccatcgaaactatacttaatcatcggtcgatccgatcatttactgacgagcttctgacagcagaagagatagatacattagtgaaaagcgcccaggcggcgtcaacgtccagttacgtgcaggcttactccatcatcggtgtaaccgataaagagaaaaagcggaagctggcggcactggccggaaaccagccttacgtcgaaaataacgggcacttgtttgtgttctgcgctgatttgtaccgccataaaaaacttgctgaggaaaaaggcgaaaacattaccgagcttcttgagaatacggaaatgtttatggtcagcgtcattgatgccgcacttgccgcacaaaacgtaagtgttgccgcggaatcaatgggacttggcatttgttatatcggaggcattcgaaatgaacttgatcaggtgacggaagtgcttggaacgcctgaccatgtgctgccgctgttcggcttggtagtcggtcatcccgctcatccgtccggtcaaaagccgcgcctgccgaaacaagccgtatatcatgaaaacacatacgatacgaatgaagaacacttccgcagttatatgaaggaatatgatgaaaccatttccgcttattatgataatcggacaaacggcaagcggattgaaacgtggtctgatcaaatcctgcagttcatgaaacaaaaaccgagaacctatttgaatcaatatgtaaaagataaaggttttcaaaagaattaagaaaaaacctctcctgaccgggagaggtttttttatgtttcacgtgtaacatatttcgacaaaatggaacaaggtatataaatgtttatcatcagggatgcttataagcatacagaaagaaaaaacggcttagcagtggtacgatgttgatgaggtgacagtgatgatttcattaagcatattagatcaatctcctgtatcagaagggagttccgcggaaagcgcgctgcggaatacagtaagactggcgcaggaggcggaaaagctcggatataagaggttttgggtgtcagagcatcatttttcagagcggttggcgggttcaagccctgaagtgctgatcagccatattgcggcgaaaacgaatgagattcgtgtaggatcgggcggtgtcatgcttccgcattacagcgcatataaggtggcggagaatttccgcgtgcttgaaggtttgacgccgggcagaatcgatctcggattgggacgggcgccgggcggaatgccgatcgcatcatgggcgctgaatgacggcgggaagcggaatgctgatcaatatccgcagcagattcgtgagctggcgatgtatttgcatgatgcagccgatgacaatcaccgttttccgaatctgaccgcatcaccccttattaagacggcgccggaagtctggcttctcggttcatcgggggaaagcgcgcttctgagcgcagaaacgggagcaggctatatgtttgcccactttattaatggagaaggcggagaaagcacgacggcacaatataagcgcagatttaaaccttctgcattaggaaaagaaccaaaaacggccgtggcggtgtttgtgctgtgcgcggatacggaggagaaagcggaggaactcgcggctgtcatggattatacactgcttgcgggtgaacaggggattccgcttcacggcgtaccgtcttacgaaaccgtccgcggaaatacgtatacaccgtatgaacaaagacgaattgccgataatcggaatcgaatgatcatcggaacgaagctgcaagtgaaagaacagattctggctctcagtaaagcatacggaacagaagaagtgatggctgtaaccattactcatcattttgaagataaacttcagtcataccgcctgcttcgagaagcttttgccgaatgatcagaaagaaaccctgctgatgctccagcagggttgttcggttattcaatgataaaaggtttttcagtcagcacctggcttgatttccctttgttcgcggcataggccagcatataatattctcctgccggcagtgcggtgtcaccattgactttgccgttccagtcgaaatattgatagcctttatcctgctttttataaatgccggcttggccgacaaagtcaagattactgtcatatacaaggaaggcaagctcttcagctcccgccggaagataggtttcaatttggtaggttccctgcgttgtgccgtcgtgcacgtcgattgacgtcacgcgcggatagtccggctcttttacaatcagcagcgtcggcacttttgcgactgtttttccgccttcacgcactgtgacggttccctcataggtgcctgcctttacttttttggcattgacctttactttcgcattgacctttccggtttgatgagcggggatcacgacccggtctgtgcccgaaacggtaatgcccgtgccgttgaaagagtactcgagctgatatgattttctgatggacgattggttttcaatcgtaaaggtttcttttttcgtttcattgcctttgtctttcataaacgttccgtaagaataacttcccggggcgacaagggagtctgctttgatcgccttcatgattctgatgcttccggcgccttgcgcattatgcgggtatacgtcaccgtccgcgtccgttaaggtttccgcggtgttcatgagagcggcttttatttgttccgggctccatttcggtttggcctgcttgatgacggcagctgcgccggctacatgcggggaagccatactcgttccctgcttcgatccgtagccgtacgggtcggccggatcatgggtcggaatggtgctgacgatgtttacgccgggagcggagacgtcaggtttaatcatccacgtgtccataaccggaccgcgtgacgaaaagtctgccatttgttcagtgagcgatttagccacggataaattgaatgtcgcttttgtgccgcccgcttttaattggctgacgagtttttcgccgtcttctgatgaaagcttaatcgtcggcactgacatgcccggtacgttggcttcaatttctcccggggcattgttatacacaaccataccgatcgcgcccgcttttttggcgttgtcggctttatcgacaaaggcgatgctgccccgtttgacgacagcgacttttcctttcagatctttgccttcaaaatccttttgctcgccgatacccgcctctatgagctctgtttcttttttattcagtgcttttatgtcatcttctttgttgtagcccattactttcgctgaggaataggaaccgaaggagacggcgtactcgttcagcggcagctgggtcgctccgacggagatggcttctctggacgttcccggagagccgacggtccaattgttcggcccgctgtttccgtttgatgtaacggccgtgacgccttctgacatcgcccagtcaagcgccgtgcttgtcgcccagtctgggttattcacagaattgccgagagaaaggttcatgacatccgctccgtcctgtacggcgcgttcgatgccggcgatgacgttctccgttgttccgcttccgcccggaccgagcacacggtaggcaaggagtgtagcatccggcgcgacgcctttaatcgttccgtttgccgctaccgtgcccgcgacatgggttccgtggtcagtcgacgcgcctctcggatcaccggacggcgtttcttcaggatcgtaatcgttatccacaaaatcgtatcctttatattgtccgaaatttttctttaagtcagggtgtttatattcgacaccggtatcaataatggcaaccttgacgcctttacccgtatagccgagcttccacgcgtcatttgcccctatataaggcgcgctgtcatccatctgcggagacacggcatccttagatagggtgatgtctttatctttgagctgatcggtatgataggtgacattcggataaaccgctttgacatcctgatcactcagcagtttggggatttcatttgccgggagtttcatggagaagccggaaaacacttgctcatattccctgttgatttttccgtgtttaatggttttgagcgctttctttttcacttttgagcgttcgcttttcagcttgctttttgtctgtgctttgccgagttcctttgcttccgccagtgacttttccttcagctccacgatgactgtcgtttgtttgccggtggtcatatcaatgtcaccgaacacctcagccttctcaagatcaggagtttgcggttttgaagccggcgcagcctgtgaacttgtggataaggtaaaggataagacaaaagccggaagcagataacggatgattccttttttcaatcgtgtttccccctttttctttatctaaattagaaatctagtatatatttcttgaaaattcaaaataatccttgtgacatatgactcatttatggaaattggtctgtgaataaggagggagttatacacagaattctgtgtataactgaataaatttgtgtatatatattgttgggaacgaatgttcctatacaaaatatagatcgagtttgtggatatgtggatatacactgtgtttaagctgtgcttaaccaagggataaggtgtgtataactttttttatcggcttttccatttttcaggtcatttccatcagctttcaacaaaacttctgaaaactagtttgttttttcactcatattgtgacaaacaattcgcccggccgcgtctatcatagagtcatagggttgctagacccgctagtttttagcggagaaggatcggccgccttttccgttaaagcggagagaaaaacaggcctgcgaacaagctgtctgtcaaaaagaagcggagggatgatttgcaatgaaacgtttgctagtatctttacgggtgtggatggtctttctgatgaattggatggcgccgggtaacggaagatatccattagccgccgtgtacggaaaccaagcggcttgtcataagaaagcgaagcggacggctggggctttttcgtttgtgagccgtgtccgatcggcggatttgaccgatgaaacgaaatcggcccgcggcaggctggataaaaaccgatggatgcctgtccgcaaagaattgccgaaacgggagcgcgcgggtccggcacctttacatcatatgaaaaagagggtacaatcccactaaacatatgaacgggagcgaacctcttgagaatagacaaagtattaaacaacaatgcggcgttaataaaagaagacggacgggaaaagatcgtaatgggtcccggaatcgcttttcaaaagagaaaaaatgatgtgattcaaaagcataaaattgaaaaaatatttgtcgtgcacgacgaaaatgaaaagttcaaacaagtgttagaaacgcttcccgaagagcatatagaggcggctgaagatatcatcagccatgcggagggagagcttgcggcacctttgaacgatcacatccacattgcgctggcggaccatttatcctttgcgatcgaaaggattcaaaacggccttcaggtgcataaccgattgcttcatgaaattaaggcgctttataaaaaagaatatgagatcggccgctgggcggttgagcacgtgaaacaaaccctcggtatatcattgcctgatgatgaggcggggtatatcgcgcttcatatccacactgccaaggcggatgccaaaagcatgtattcggcgatgaagcatacaaccatgatcaaagaaatgatcgaaaagatcgaatcctttttcgaacagaaggtggatgaagacagtatttcctatcagcgcctcgtcacgcacttgcggtatgcggtcagccggttggattcaaatgaagcactccattccatggacgaggagatgctttatttcatccaaaaaaagtatccgtttgcttatcggtgtgcgcttgaactggcggcgtttttaaaaactgaatatgatttggaactgccggaatccgaggccggctatatcacgctgcatgtccagcgtctgcaaaaaaacccggaataacgcgtctgtttcgagaaacagactttttttttgaaaacatattgacgaaagcgctatcatggaatagaatgaaagcgcattaaaaaaactgaatccggcgggattgtgactggtaatgcaggcaagacctaaaatttgcgtacatgaaaaagggatcatgctgacctttttcgttggcgaattttaggtcttttttgattttagaaagggggatacataatgaattatcaagaaacggcaaaacagcttatcaaacacatcggagggaaatcaaatatcatcagcgcgacacattgcgccacacggctcaggctcgtcattcaagatgaacagaagatcagccaggccggcattgaagagacagaaggagtaaaaggggctttcagcagctcggggcaatatcagattatattcggcaccggcctcgtgaataaagtgtatgacgctttttcaaaagaagccgatttggagcgggaggatcgtgagacacatcaggacgcagcgaaaaaaaagctgaatccggccgcaagatttgcgaaaacactgtctaacatattcgttcccatcattccggctatcgtggcaagcggacttttaatggggctgctcggcatgatgaaggcttttcactgggtgtctgaacaatcatcgctgtttaagcttctagacatgttttcaagcgcggcgtttatctttctgcccgtattcatcgggttcagcgcggcgaaagaatttggcggtaatgcctttctcggtgccgtgctcgggggaattatgatccatccggcgcttttgaatccgtgggggcttgcggatgtaccgcctgattttatgcagctcttcggcttcgacattgcgctgctcggctaccaagggacggtcatccccgtactgttagccgtttacattatgagcaaagtggaaaagggcacgcgaaaaattgtgcctcacgcattcgatttattggtcacgccgtttgtcacggtgattgtcacaggatttatcacctttatcgcaatcggtccgcttggcagggcgatcggatcaggcattaccgtctcgctgacgtatgtgtatgatcatgcgggcattgttgccggactgcttttcggaggtctttatccgcttattgtgcttaccggtgtgcatcacagctttcatgcgattgaggccggcctcatcgctgatttgggcagaaactatatccttcctatctggtcgatggcgaatgtcgctcagggcgcggcgggactggctgtatttttcctgacgaaaaaagcgaaaatgaaagaaatcgctttgcctgccgcattttccgcttttctcggcgtaaccgaaccagtcattttcggtgtgaacctaagataccgcaagccgtttatcgcgggaatgatcggcggagcgctgggcggagcctatgtcgtggtgaccggtgtcgccgccaatgcctacggtctgaccggaattccgatgattgccatcacggctccgctcggtttaggaaatcttataaactatctgatcggaatgggcatcgcctctgtctcagcgtttattgccgcttacattatgggagctaaagaaaaggaggccgtcaaatgaggacaccggatcaagagctgcgcctgcaggctgaggaagcgaaaaagaagcggggagaaacagccgcatcagatccataccgccagaactatcatattatgccgccggtcgggcttttaaatgatccgaacggcgtgatccaatggaacggcgtatatcacttgttttttcaatggcagccatttcatacggggcacggcgcgaaattttgggcgcatgtgacgacgaaggatttcgttgagtggaaagaggaagaaatcgcgcttgcgccgggtgagtggtatgacaaaaacggctgttattccggaagcgccatcgaaaaagacgggcggctctgcctgatgtacacaggcaatgtccgtgacggagaaggcaatcgggaaacgtatcaatgcctcgccgtatccgaagacgggatcgtatttgaaaaaaaaggagtcgtcgcgcgtctcccggaaggctataccgctcatttccgtgatccgaaggtttggaagaaagacggagcgtattacatggtgctcggcgcgcagacggaaaagctcaccggaagcgctgtattgttcacatcggagaatttgacggattggacgtttctcggtgcgattgcgggggcggactccggcggtctcgggtcattcggctatatgtgggaatgtcccgacctgttttcccttgacggaaccgacgtgctgctcgtatgtccgcaggggcttgaagccgacgggataaaatatcataacagtcaccaggcgggctatttcctcggcaggctgcatacagagccgccagaatttaagcacggtgaatttacggagcttgacagaggatttgatttttacgcggcgcagacgctggaagatgataagggacggagaattctgttcgcgtggatgggcgttccggatcagcatgaggacaaacatccgacacatgcgtatcactggattcactgcttaacgatgccgagacagctgtcactgtccaacggcagaatcatacagcgtccgcttccggaaatgaaattacgccgcacggatgagcaaaagcgccgtcttcaattggagtgctcgtctgtaagcctgccggtgaaagatgcgtcccgggctgaagtgctgctggaagacatcacttgcgaatccggttttgaaatctcaattcggggcgcggcccggtttatatttcatcaggaagaggggctggctgtgctggagcgcaccgctttcagcggagaagaaaaagaaaagagaagctgcgccatcagcgaggtggattccgtgcagctctttctggatgcatcctcgatcgaattgtttttgaatgatggagaagaggttttcagcgccagatattttcctttcccgggaaatgatgacgtaaccgtcacttcggtaggaaaaacggaaataaatggctcaatttggacacttttgtagaaaatcgttcttttttcttatgtgaaacctatgccatctgtgctattcttcaaacgaaagactatgattccaggaataaaaggagttgttttctcagttttgaaaaatcagaagatgacgccgaaatgtttacttgtcaaagccgcagagcaagtggaagataagcgggaagaatataaagaagtattgcttcagctgaatcgcatgctcaagagggctgagccgcacaatgaatggagtgatcggctgatgcatacatatgaacagatgaaggaatatgcgctgtttgtgcaatcgattgagatgtttttacggtcatccgcgaaaaaaatgaaataatccccctcgatcatgagggggatatttattttattttccgctaagacgcatcgccgaatgtttagtcggtccgatgtattggttcagcgggaaggattctttgattgccgcggtgataaattctttcgccgcatagatggcttccttcacttcagcgcctttggccagttctgccgtcacggcggcggagaatgtgcatccggctccgtgcgtgtaaggtgtatcaatcatttcgctttctaatacttccgcggtttctccgtcatacagcacgtcgatcgctttttcatgtttcaatttgcctccgcctgtaatcaatacatatttcgcgccgagttcgtgaattttcttggccgcttctttcatgtcttccaccgtttttaattcatccataccgctcagctggcttgcttcaaacaggttgggcgtgatgacggttgccagaggcgccaattgggtgcgaagcgcttcggcatgctccggatacagcacttcgttcgctcctttgcagaccatgacaggatcgataacgacattcttcagctgtttttctttaatcgttttcgccgcaagctctatgatctccacggtagggagcattcccgttttcatggcgtctacgccgattccgtcaacaatcgtcgccagctgtgcgcgaatcgtatcagcatcgatcggaaatacttgatgatcccagctgttctccgggtccatcgctacgatcacggtcaaagccgtcattccgtatacgtttttttcttgaaatgtttttaaatcggcctgaattcccgcgccgccgctggaatcagaaccggcaatagtaagtgctttgtgcattgacatatcaatggcctccatcagtgttttatatctcattatagttagattttctcccgatcacaatacggaaggcttggaggaatgatttgacagccgcgggggatgtgcgtacaatacctacataagattactaggtaagggtgagaaaataaatgctcaacagggagcttgtaaagggaagcacggtcattctggtgctgacgctgctgaatgaacggcccatgtacgggtatgaactagtgaaagaaatggagaaaagaagcgggaatgaactgcaaatgaaggaaggcacgctgtacccatcgcttcataagcttgaacgccaaagctatatttcttcttactgggaaaagcagaccaaagggccggaccgaaaatattaccggatcaccgatgaaggaaaaaacattctagccgaacggacgaaggaatggaatctgttctctgctctgatggaccggatgctgaagcggggcgggcagaatggataaagacctttatgtgcaggaaatcagaaaagggctggaaggcaaggccggaagccgtgaattattaaaagaaatcgaaagccatattcatcatgccatatgtgatcatctggaaaaaggcaaaaccgaaagcgaagcgatggcgcttattctgcgggaagtggggactccgtctgagattatctctgcttttcaaaaagcttcggcggtgcccgcgcggacttttatgttcttttatctgttctgcaactgcggtctttttgtgatgggggcgatgattacggtgatgcacgcgtggaggattcatcccgctgttgacgcgctgtggaaaggaatttccgtgtcagtatggctgattatgatcggttatgtgctgtattggttccaaatcggctatcaagctggcaaggagttcggggctggcggcaaaaagcttgctgagcggacggtatgggcttcaatggtgccgaatctatgttttatgtttgtctttttgttcaatctggttccggctgggctgtttccttcggcggtcacaccgagttttgcggcagtatgcgccgttgtgacggtatgttttccgttttgcggcaaaataggtttttacgcaggcaggcagagacttgcctgatctttttcactatatacatagggaatctatataggggtgttaaaatgagattaggttcgtggatgtacggcgcgtgcgcccaaataaccgttaccgtatttaccgtctgcggcttggttcttgcattgcccgttgtgagtctttttattatggttctgaatgggatgcaagacgctatttttgttgttttcagtattttgcttcttctattgttttatgcgctgggatggatttgggccgtttcgtttgcgcgtgagtggaaggtgaaacttttcgagctgcagatcagttcgctcattccgctggcgggtatattatacttgtacattgacagcggggtgagtataccggaactgattcatgattggcatgaggatggatgtgcgcttgtcccgccggcttttgtctgcttgtgcacatgctatgcgatggtgttggtgcctgtttatcaatcaaaactttggaacgccatggaggcgggcagacttaatgccaaggcggtatgcactgtttggggagaccttctgatcattctcgttttgctggcgggcatgacctggatttgtttctgaatgggccgaaatcaaaaatcccccctgatctctccgccgctttatgttttaatagaacatgagaaaaaagcagaaggagcgggtcatgaatatatcaattgtcatagtcacgtataaccggattccggctttgtgtgagctgctggagtcgatttccatgcagaccataaagccttatgaagtcatcatcgtaaatgatgccggggaatcggtcgaacaagcgaagcagctgtacagcgatctgccgattcagattattgatttagaacagaatgccggacatgtggaagcgcggaacgcaggtgtgaaaaaagcgtcgggtgattgtatcatgctgtgcgatgatgatgatttcattacgccgggccatttggaaagaatggcggctgcacttgctgatgcggattttgtccattctgacgcggaaattgtgtcatttgaagaacggggcggcacgagatacccggtgtcacgaaagccgttcgcttatacggcggattatgcggatatgcgggttttttccacgtacgttccgtcaggcagcatgtacaggcgttctctgcatgacacgttagggtattttgatccggatgtccataattattgggactgggacttttatttgcgcgccgcgaaacagcaccgtgtgaagcgtgttccttgcgcgagcgtcatatatgcgttttttgagggaggcggcaatcagtccgcggatctcggcggcaaacggaagcggtacttagaccggttaagcgaaaagcacgggcttggggagctcccgacgaaaaacttcgcggttcttcttgaagagccggacatgaagaggcgggaggcgccgactgacattgtgtgggacggaaagcccgtccattcaagactgcacagttcataaggggggacggacagtttgaaacagcttttaaaggacagctggtggaatcagctgaaagatgaatttgacaaaccgtattatcaagagctgagagaaatgctgaaacaagaatacagcagccaaacgatttatcctgacagccatgatatttttaacgccttgcattatacgccctatgaggatgtaaaagcggtcattctcggacaggacccttatcacgggccaggacaggcgcacgggcttagtttttccgttcagcccggggtcagacagccgccgtctttgaaaaatattttcatagagcttcaggacgatatcggctgctccgtaccgaaccacggatcactcgtcagctgggcgaagcagggagtgcttttgttaaacacagtgcttacggttcgccgcggtcaggccaattcccacaaaggcaagggatgggagcggctcactgaccgcatcattgatgtggtgaatgaaagagagaaaccgattgtctttatcctgtgggggcgtcacgcgcagatgaaaaaagagcgcattgacacatcgaaacacattattattgaatcgactcatccgagcccgttttcggcaaggaacggttttttcgggagcagaccgttttcccgtacaaacgccgcccttgaaaaaatgggggagcagccgatcgattggtgcatccccgacctgccgcaataaacgttttttttgaggcgcttccgcccggcggaagcgtcttttttggcgttccgggcggtatgccgccagaaaaaataacaaactcaattctgcgattcactcagaaatttgataaaatgcaggaagaagacaaattactgctggaggatttactcatgaacatacatatctctgctctgattcagaagatggaagaagaactgaggcaggcgaaaacagcggcccgcaccgaggaggtcaaaatgcacgcggccgccatccgctctctgtgtgatgtcgtgctcggcactcagacgcacaccgatccggctcctgtgcagaatccgattccgaaagcggcgccgaaaccttcagcgtctccttcgacagacccgctgctgcttgaaaaaatgatgggcagcgccgggctgaaccaatatcagaaaaaagcgaaagacgaacgtgaggaagacggaaacggggattccattttcgatttttaacaggagaggttgattgacttgaaactgatactcgggggtttgcaatggacggcatttatgattgcggctgcgattgtagttcctgtcgccatcgcacaatcatttcacttgaaccatgccgattctgccgcattgattcagagcacattttttgtgcttggcgtcgccgcggtcatccaatgtctccagggacatcgtctgccgattaatgaaagcccggcaggcttatggtggggcgtatacacgatttacggcggactgacgggcacggtgttcgcgacattcggcgagacgctgcgggcgctgcagggggcgctgttattaagcgctgtctttttctttttgttcagcctttttaaagtgattgaacggctggccgtgctgtttacgccggttgtgaccggtgtgtatctgctgctgttggtcatgcagctgagtcagccgattgtgaaaggccttttgggcatcggctatttaaaaaacagcgtcgacggccttgtattcgggctcgccatggttgtgacggcggcgatgttcatcatgtcccgatcgaatgttacgttcttaagacagtatgcgattctcctttcgcttgccggcggatggatcttattcgccgtctttggcgcagccaaaccgattcaaataccggaccgcataattcagctgccggctctttttccgtttggaaaacccgtgtttgacagcggcctgatcattacgtcactcttcattaccgttcttttgattgtcaacatgctcgcgagcatccgggttgtagaagcggcggtgaaaaaattcggcggcaccgttgggaagcggcgtgagcgtccggcagggtttgcggcttcgatcagccaccttttgagcgggctgtcagggggcattgcgcctgtaccgatttcaggggcggccggttttattgagacgacgaagcttccttcgaaaaagccgtttcttttgggaagtgtatttgtcatgatcatcagtatgatcccgctatttatgaatgcgtttgcgagtctgccctcaccggtcggctttgcggtaaacttcgtcgttttctccacgatggcgggtcttgcctttacggagtttgactcttatgagaaagcggagcaaaaacgaatccgctccattatcggtctggcgctcctgacgggggtcggcgtaatgtttgtgccggagagcgcgttatcagggatgcacccgatcctgatttcgctcttaagcaacggccttgtgctcgggacgctgctggcgatagcgattgaccgaatccagcttatcaaaaagaaaaaatccgacaatctcgtgtcatcggatgacggacgttgaattttgccgatgttgggttatgattgaattggaaactttaacgaaaaggcgggagaaaaatagatgaaagtgtttattattcttggtgcgattaacgctttattggccgtggcgctgggcgctttcggcgcgcatgggcttgaagggaaaatccccgataaatatttgcaggtgtggcacacaggcgtgcaatatcatatgtatcacgcgctcggtcttctggctgtcgcgtttttggccgaaaagctctctggcgcaggcagtgtttctgttgcgggctggctgatgtttgcgggcatcgttctgttttcaggaagcctgtacgtattgagcgtgacgcagatttctattctcggcgcgattacaccgctcggcggcgtggcgtttatcatctcttggattatgattatcgtcgcggccgtcaaatatttataaagaaaaaaagccaatcctctgtcaagtgagcgattggctttttgatttatctcggagaataagaagacatggagtacggataagtataagcgatttcctcatcaaacgtgatgtaatcaaggtaaatggtcagaagcagatagcgggtgcccgttttcggatcgctgatgatgatatggtcacgtcccgccgcctgaatcacaccgcggaaaatctttgaattccattctttgctgttttcaaatgtcatataaatcgtcgccgttttgccccggttcaaccgcagaatattttcaatgtatgactcttcaatcggcagcatgccgggaacgttttgtgacgatgatggacctgacggaatctgaaagctgccgccgccctgctgctgcggctggccggggaaccccccgccgaagccctgctggccctgctgctgcggctggccgggaaaccccccgccgaagccctgctggccttgctgcatcggcattgtcatttgctgctgcatcggcatcatttgcgatccttggccgccctgaggctgcggataaggattaggcccgagctgcggctggtatccttgcatatccattcccatccccatcccttgcatttgctgatattgattctttttcggtttcatattgttcctcctttgatgaaaacctcttcatgctgaaacctcctgacaagtatcagacagccgacagagaagctgctgtttttatctattccaccatatgagcccgcagaaagatttatgcgaaaaaagaaaatacgctccaatgagtccggacatcagagccggttttttttgtgcgcgcaatgctgacttttcacataatagtctgtattcctatcgcatcttccgcataaggaacatatgatagcggtagtttcaggtgcgaaaagggggtgacgagttgcctaaagtgtcagtgatcatgacgagctataacaaaagtgactatgtggcccgctctattaaaagtattctgtctcagacgtttacggactttgagctgttcattatggatgacaactcaaatgaagcgacattggcggaaatacgtccttttctcacggatgaccgcgtccggttttatcaaagcgatgtatcgggcgtcaaagaaagaacggaaaaaacacgctacgccgccttgattaatcaggcaatagaaatggcggagggcgagtacgtgacgtatgcgaccgacgacaacacgtatgtgccggaacggcttgagaaaatggtgaaagagcttgatgaagacccggaaaaagccgtcgtgtattcaagttccaaaacctatcatctgaatcagcggaaagagacggtgaaggagacggccaggcccgccgaacggatcgtgtggaacgcgccgtgcgccattgaccattgttctgtcatgcaccggttttccgtgctggaacaggtcaaatcggcattcggttcctattgggatgaaagccccgcgttttaccggatcggtgacgcccgtttcttctggagagtgaatcatttttatccgttttacccgatttctgaggagcttgatatcaattatattaccgatcaatccatccattatcagcttttcgcggcggagaaaaacgagtttgtgaacagccttccgcagcagaccacgtgccgggagctgagggaatcattaaaaaagcttggaaaggggtgagggcttgtcggcatacttagcgaattattgggtgctgtaccggcagtatattgacctttttcagtcacttcgctacaaagacatcccgctcacattgatcagtaatttttatcaatatatcagtccggcgcttcgggagagcatggagcagaacccagagcttttcggtccggctgatcagcatattcctgaagccggtatacagccatattatgatcaaaaaaggcaaaacattaagaaaacagatgagaaaccggtaaacggaaaagtcattctgcatttcgatcatattcggttcaccgagagaaactaccggcagtttgatccggcaaaaacagcggtactggccagatggagtctgcctgaccattacgggctgcccgttatctgcaaattggagctgacgggaatggggcaaaaagggaaccccgtcccttatattgaaaaagcccattccattttgaaagagcttcacagccatcccgctttcggaaacagagaatttcaggaacgtttgtataaagacattccattatttattgaagcgattgacgccgttgatattttgtttacggccgagaagatttccgccgttgtagtcggcacgacggaggatatttacagccgtgtgctggcgctgatgtccgcgaaaaaaaacgccgtcagcatctgtctgcagcacggagcgctcatgggagatgaagcgtttctgcccgtatttacggactatcaggcagtattcggggcttatgaagcggagtggtataaagcaaaaggctgcagggatgaacaaatcatcatcacggggcatccccgtttcgacgagattttctcaagagagccgatagatcaagacacgttttaccgcaaactttcttttctcccgtcacagcggacggtgctgatcgccacgcagccgttttctgatgaattttatacgggcgtgcttgaagagcttgccggccaaaagaacatgcagctcattattaaaccgcatccgtgggaaatcggcaaaaacaagctggatgcttacaatcaggtgctgcggaaatataaagcaggcaaaatcatcaaaaaagagatggagctgtatgatattctaccgtatgttgacgctgcggtgacacagacatcaacggtcggtcttgaagcgatgctgtttcaaaagcccgtgctgatcggaaaatcagcgggaacccgccgatacccttattatcattcacttggagaatttgtttttgaggacccgcaggcacttgctcaggaattaatccggatatgcgaaagccccgcggaatatcaaaaagcggaacaggcgcgccgtgcttttgtcgccgcgaactacccggttcaggattcgcttgccgctttatgccaagtgcttcaggaaaaaaccggagtcagcttcagacgggttgacccttcataaaaaagataggagcgcaaagaaaatggtgcaaaaaagatcagcttttcttccttattcattgcccatgatcgggaaggacgaaattcaggaggttattgatacgcttgaatcgggctggctttcaaagggaccgaaagtagaggcgtttgaaaaagcctttgccgcctggacgggggcaaagcacgcgatcgcgctgaactcatgtaccgccgctttgtttttggccctgaaagcgaaaggaatcggtcccggcgacgaggtcatcacgtctgccgtgacattcagttcaacagccaatacaatcgtgcacacaggcgccgttccggtgtttgttgacatcgatccgcttacgctgaatgcggaccctaaaaacattgaggcggccgtcaccccgcggacaaaggcgattgtacccgttcatttcgccggccagtcgtgtgatatggatgagattctggccattgccgaaaagcatcagttatttgtcttagaggatgccgcacatgccgtgtataccacttataaacagaaaatgatcggatcaatcggtgatgcgacggcattcagcttctacgcgacaaaaaacctggcaaccggtgaaggcggcatgctgacgacggacgatgacgggcttgccgatcagatcagggtgctcagccttcacggcatgagcaaaggcgcgtggaaccgctattcttcaaacggaagctggtactacgaggtcgaaacgcccggctataaaatgaatatgtttgatcttcaggcagcgcttgggcttcatcagctgaaacggattgacagcatgcagcaaagaagagccgacattgcgagccgctaccaggacgccttcagacacatgaaagggctgaccatcccgcatgtcagtgatgacggacggcatgcatggcatctgtatgttcttcaaatagaggagcaggaggccggggtcagccggaacgatctgatttccgctttaaaagaccaatatcatatcggcacaagtgttcattttattccggttccgttccatccgtattatcaaaaaacgtacggatataaggaaactgactttccggccgcggcagcgtattatcaccgcaccgtgtcactccctctttatccgtcaatgacagatgacgacgttgaatacgtcattgcagccgttacggatatcgtcaaaggggctgattaggtgtacagactgagggaaaatcttgctcaggacatgattcatgccttcctgcatcagaagggcatccagccggaagcctatgaatcgtcgctctgtttattggaggaaaacagccttcaaggcgtgattttatatgaaaactcttcgtgggaaagtcaattgttccgaaaaaatatcatcaatgtgaagcttgcagccgcaaacagcaccggacagctcaaaaggctgtttcaggaattttacgcggcaaggcgggcggcaggcactgattttatatttattaaaataccggctgaagatatcggcgcgatgcaggtcgttcagcagcttccgaacgcttattttgtagggagtctgctcaagctcgtcagcccggtgcgtgtttataacagcacgccgccatttgagattacagaagccggacccggcgacacggaagcgatcagccggctggcccgcgacgcctttacaaaaagcaggtattaccaagatccccgcctcagctatgaaagtgcaaaccgcctgtttgaagagtgggcgcggaataacgcggaaggcagagcttcgttacaattcgccgccacatataagggagagaccgtgggctttgttcaggggctgtctaaaggcgatgaattcgtccttgatctgatggcggtaaagccgggctttgaaggaaaaggagcgggattccatttagcggcgcacgtgattgaacaatcattgcgctttcagcataagactgtatcagcgggaacgcagctccacaatgtaagagccatccgcctgtatgaaagaatgggatttaaagcggatgcgtcctattactactatcatgtgtggcccgggaaggaggcggactgatggcatcatgcaaaatcggaacgaagtcaatcggcgaaggttcgcccgtattcatcatcgccgaagccggaattaatcatgacggaaaactgagccaggcgtttgaattgatagatgcggccagtgaggccggcgcggacgcggtcaagtttcaaatgtttcaggctgacaaaatgtatcagaaagacccgggcttgtacaaaaccgctgcgggaaaaaacgtctctattttttctttggtgcaatccatggaaatgcccgccgagtggatcgaaccgctgcttgaatattgtaagaaaaaaggcgtgctgtttttaagtacggtatgtgacgaaggctctgccgacttactgtatgcgacttccccttcagcctttaaaatcgcctcctacgagctgaatcatctgccgttattgaaatatgtcgcggggctgaagaccccgattattttttccaccgcgggcgctgatatttcagatattcaggaggcttatcaaaccattaccggcgaggggaacacagaaattgcgatcatgcattgtgtggcgaaatatcccgcgccgcctgaatacagcaatctgagcgtcattcccatgcttgccgccgcattcccggatgcagtgatcggtttctccgatcacagcgcccatccgtatgatgtgccgtgcgcggctgtcaggctcggagcgaaactgattgaaaagcattttacgatcgataaaaacctgcccggtgctgatcactccttcgctctcaatccggatgaattaaaagaaatggttgcggcgatccgctcagttgaagcggagctgcggcaggggcatcacgctccggtgccggaagtgctgtcgggaagttctcataaaacgacgacaccgattgaaggggatatcagaaggttcgcttacagaggcattttttcaacagcgccgattcaaaaaggcgaatattttacggcggaaaaccttgccgtccttcgtcccggccaaaaaccgcaggggcttcacccgagatattttgagcttttaactgacggggcgcgtgcggtcagggatatccccgccgacacgggcatcacttgggatgaccttttgacgaaaggcagcccatatgatgactgacattttgtttatcattcaggcgcggatgggaagcgggcgtcttcccggtaaagtgctgaaaccgatcggcgggtatacgatcctcgatatgattgtcaaaagggttcggcaaagcgagtattatgatcaatcgcgggataatctgatcgtcgcctcgtctgacagcaagaccgacgacattctgtctgcgcactgcctcagcaagaactaccgtgtgcaccgcggcagcgagcagcgcgtgcttgaccgttttgcacaagtcatcgaacgagtaaaaccggacatcgcagtcagactgacgggggataacccgtttgtcgacccttcgctgcttgattttctgattcaatcgcatttagatcagcacgcagactacacgtatatctgcggtacaccgctcggcatcggcggcgaggcggtaaacgcgcgccttttaacggagatcaatgccgacaaaacgctggcggacaaatatcaggagcatgtcacgcttttaataagagaatctgctgagaagtaccggcttctctttcctgagcccccgcaggaactccgggctcctcacttgcggatgaccgtcgatacagaagaggactacaggctggcccgcgagctgtacgtaaaagcgggctcgcgtcctgatattccggcaagagaattgatccatctgctgaatagtgatccggagctcagggccattaatcaaatgatccggcaaaaagaggctgattagcatgcgggttttgattttcgcggacgggggccgtgacatcggcatggggcacgcggtccggatgaagctgcttgccggtgccattaagaacaattgctcaataacgttctacacaaataaagaggctttttcttatctgtcatctgatcaatgggaagtgatcatcaagcctgtcaagggacagaaggaatttattgtccgggaaataaacaggcaggctcctgaccttctcatattcgatctgctcgatatgccgtgtgactggttagaggaaatcaaaaagcattcatcggcacgtatcgttttatttgaagaaaaacgggaacatgtcattcatttatgcgatgccgttataaacggcatttacggagggctgaaaagccggacggttcaaatgggcggcgccgttgtatatgaaggcccggaatatatcattcttcatccgggttttgaaaaagcaaagcagctctatcagctgagaaaagaatgccggaccatattggtttcattaggaggaagcgacccgaagaagcttgtctttaaagtgatggaagcatgccgccgcatccccgatattcagcgaaaacgagtgatcatcgtcatgggcggcgccgcgcctcatgctgatgacgtgcgcgcgcatcttacacaaatgccttatgccgagatggtaaggcagacaaatgacatggccgcgcttctttcgagggctgatatggccgtcgtgtccggcgggatcactttatatgagaccatttgtacgggtgtgccctgcatcgttctttctcaagtggagcatcaaactgagacggcggaaaaattcgccgcacggggggccgccgttcatctcggccttggtgaatgcatatcagcggacgttctcgcacggcatatgtctgacatggccgctgattatccgatgcggtccggacttcatcaaaacggaaagccgctggttgacggcaggggcatcaaacgggcggcggcgattctttatgatttgtgataaaaccacacgtaaggaagtgttcatgtgaaaggtgttatcttagccggaggcaccggctcacgccttatgccgctgacaaaagcggtcaataagcatttactccctgtcggtccatatccgatgatttactggtcgatcatgaagctggaagaagcggggattacggatatcttgctgattacgcaaaaagaatatattccgcaatttcataaacttctcgaaaccggagaagaactcggcgtctcaatcacatatcaggttcagccagccgcatccggcatttccgacggtttatcatacgcaaagcggtttaccgggcgcgacccgtttgtcctgcttttgggagataatatttttgaagattctttaaaaccttatacggagcgtttcgcaaagcagggaaaaggagcgaaagtgctgctgaaagaagtggacgatccggagcgcttcggcatcgccgagattgatgaggaaaacaaacggatcaagtcgatcattgagaagccggagcagccgccgaccagactatgcgtcacagggatctacatgtacgacgcagaagtgttttcttatattgaacaaatttccccttcaaaacgcggcgaactggaaattacggatgtcaataatttatacattgaacacagtgagctgacgtatgatgtgttaacgggctggtgggtggatgcgggcacgcatgaatcgctctacctcgccggaagcctggcgcatcaggcattacagaaagaacaggagcattaatcatgacaaaatcatatttaattacagggggcgccggatttatcggccttaccttcacaaagatgatgctgaaagaaacggacgcgcagattaccgtcctggataatctcacgtatgcaagcaggccgcttgaaatagaagctttaaaaaagaacggccgtttccgttttatcaaaggtgacatttctaaaaaagaggacattgacaaagtcttttcccaaatgtatgacgctgtcattcattttgcggctgaatcccatgtggacagaagcataaatcaggcagagccgttcatcacaacaaatgtgatgggcacataccgactggccgacgcagtgttacagggaaaagccggcaggctgattcacatttccacagatgaggtgtacggagatttggcgccggatgatcccgcttttacagagacgacgccgctttctccgaacaatccgtattccgccagcaaggcaagctcagacctgctcgtcatgtcttatgtgaaaactcataagcttccagccatcattacaagatgcagcaacaattacgggccgtaccagcatcacgaaaaaatgattccgaccattatcaggcatgccgtaaacggcacgccggttccgctgtacggcgacgggatgcagatcagagactggctgtttgccgaagatcattgccgcgccattaagcttgtgctggaaaaaggaacactcggtgacatttacaatatcggcggcggaaatgaacggacgaataaagagcttgcgtcatttatcatgaaggagctcggtgtcgaggaacggtttgctcatgtcgaagacagaaaagggcatgaccgccgttacgccatcaatgcttcaaagctgaaaaatgagctgggatggcggcaggacgtcacatttgaagaaggaatgagaagaaccattcgctggtatacagacagccaagactaatcggaaagaaggggatccgattgacgaaggtattagtaaccggagcggccggccagctggggcgggagttatgccgccagctgaagcgggaagggtatgaagtgatcgccttgacaaaagcgatgatgaacatatccgaccagcgttcggtgcggcactcgttcagccattacaagccggatatcgtcgtcaatacggcggcatacacctccgttgacaaatgtgaaacggagctcgacaaagcgtatttaataaacggaatcggcgcttattatgccgcgcttgaggctgaaaacaccggcgcgaaattcattcacatcagcaccgattacgtcttcagcggcaaaggaacacggccataccagaccgacgatcccgcagatccgggcacgatttacggaaaaagcaaaaaactcggcgaagaactgatccggttgactggaaaaaaccacaccattatcagaacatcgtgggtgtacggcagcggcgggcacaactttgtcaatacgatgctgaaacttgcggatacacatgatcaggtgcgtgtcgttaacgatcaaatcggggcgccgacgtacacaaaggatttagccgaaacggtgatcggtctgtttgacaggccgccgggcttataccacgccgcaaacagcggagtgtgcagctggtatgaatttgccaaggctatttttgaagaaagcggcagaaccgccgccgtgctgcccgtcacgacggaggaatacggaaatgagacgccgcgccccgcttattcggtgttgagtcttgagtcgattgaacggcaggggctcggcatgaggcattggcgggaagcgctgcatgattatttacaaagggagggacagtgcaagtgatcgaaggcgtaaaaatcaaaaagctgatcaaacacagcgatgaccggggttttttctcagaactcgtccgtgacgatgaacatctcttagagcgtttcgggcaggcttcctggtccaaaagctatcccggcgtcattaaagcatttcactatcatgagaaacaggatgacctgtggttttttccgacgggtcacgcccaggtcgtgctccatgaccttcgcgaagagtcggcaaccaagggagaaacggatgtctactacatgggagaagacaatccgatgctccttctcattcccaaaggcgtcgcacacgggtacagagtgctgggcgaaaccccgctgaccattatttatttcacgacgatgtcctacaatccggatcagcctgacgaaaaaagaatcccgtggaatgatgacaccatcggatttgactggcagacggctcaccggtagcgcacaagacgaagacagcggatgtcttcgtttttttgtgctgattcatctcgcgaaaaataaatgattgaatattctaaaaaataatttacttccatggataaaggtggtagattattctcaggaaaagagaaacccaattcgcgaatggaatcatcagacacgcttttccggcagaggacgctctgaatcctatatgatctggaggaattcatgatgttaaaaagaaaatcattttctgcctttctcatcagtgctgcggtattttcagctgtgttcttgccatcttttcatgcgaacgcccaatctgccgttattgaagcgaaaaccgtcaatagtacgaaagaatacgcgacgtctgatattgaagtcacatacaagccgaatgcgctgcttgccgtcggggccgttgaatttcaatttcctgacgggttcaacgccactgtgagggactctgtaaacggaagaacactgaaagaaacgcaaattctcaactacggaaaaacggtcagacttccgcttacccttgacttattgggcgcgtctgaatacaatctcgtcctggtgcgtaaaaaccttccgcgcgcgggcacgtatacaattaaaggcgattacgtaaacggtttgggggccggcagtctctatgccgaaacaaagctggttattgacccgcgttaatccgggatgaaagaggctgacaacagcctctttttttacacacaaaaacctggcatgaatcttgcatataaaaaggggcgtaacgacaatgtgaaagggattgatgggttttggtgtaaaagcgcttacattttgttctgccggtaattgaagcttacacgtaaaatacgatgaggtgataaaacatgtcagccaacccgctttctaaaagcaatcagaaagatgaagaaaaagaagttcttaatttgttcttgtccacacaatcgatcataaaagaggccctgcgcaaactgggctatcctgacaatatgtatgaactgatgaaagagccgatgcggcttttgaccgtacgcattcccgtcaaaatggacaatggctcagtacaggttttcacgggctaccgctcacagcataatgacgcagtcggcccgacaaaaggaggcgtgcggtttcatccggaagtcagtgaagaagaggttaaggcgctttcggtctggatgactttaaaatgcggcatcacaaatcttccttacgggggcggaaaaggcggcatcatctgtgatccgcggacgatgtcattcggagagctggaacggctgagccgcggatatgtgcgcgcgatcagccagatcgtcggtccgacaaaggatattccggctcccgacgtatataccaactcgcagattatggcatggatgatggacgaatacagccgcctgagagaatttgattcaccgggattcattacgggcaaaccgatcgttctcggcggttcacaggggcgggagacggcgaccgcgcaaggcgtcacgatttgtattgaggaagccgttaagaaaaaagggattccattggaaaatgcgcggatcatcattcaggggttcggaaatgcggggagctttctcgctaaatttatgcatgacgccggcgccaaggtgatcggcatctcagacgcccacggcgctttgtatgaccctgacggccttgacattgattacctgctggataagcgggacagcttcggcacggtgacgaatctcttctcggatgtcataacgaacagggagctgctggaaaaggactgtgatattctcgtgcctgccgcaatctccaatcagattacggctgaaaacgcccatcacattaaagcctcaatcattgtggaggcggcgaacgggccgacaacgatagacgccacgaaaatcctgaatgaaagaggcgtgcttctcgtgccggatattttggcaagcgccggcggcgtgacggtgtcttattttgaatgggtgcaaaataatcaaggcttttactggtctgaggaggaagtcgccggaaaactgcgcagcgtcatggtgaattcgtttgaatccatttatcagacagcgcatacccacaaagtcgatatgcgtttggccgcctatatgacgggcatcagaaagtcggctgaagcggcccggttccgcggctgggtataagtgttacccgcaaagagattttgcgtcagttatatagcagatcgcaaaatttctttgcgttttcagattgcagctgacagattcggacaagcttcgtccgctttcggcaaagattttcttatttttatcacaaattgctatgctggtatgcttcttgcatcttcataaagcgtgagcacacattacaaaatacggggaggaattctaatgacagtttcatacgcacacgaaccatttacaaattttcaggaagagacaaataaacaatcgtttcaggaagcgctggcttatgtgaattcacagctcggcaagcattatccgcttatcatcaacggtgaagcgattgaaacggataaaaagatcatttccgtcaatccggcagataaaaaagaagtgatcggttctgtatcggcagccggaaaagaacttgcggaaaaggccatgctggctgcgctgcaggcatttcaaacatggaaaaaagtacggccggaacaccgcgcgaatgtgctgtttaaagcggcggcgatcatccgcagaagaaagcacgaattctccgcgtatctagtgaaagaagccggaaaaccgtggaaggaagcggatgctgatacggcggaagcgatcgactttttagagtattacgcccgtcagatgctgaaactgaaagacggttcccctgtaaagagccgtgacggagaatataatcagtatcactatgagccgcttggggtgggaatcgtcatttctccattcaacttcccgcttgcgatcatggcgggaacggcggcggcagccatcgtaacaggcaacacgatactgctgaaaccggcggatgcggcgcctgtcgtggcggcgaaatttgttgaagtgatgaaagaagcgggcctgccggacggcgtgctccaattcataccgggcgacggaggagaaatcggcgactatctggttgagcatccaaagacgagatttgtgtcgtttacaggctcccgcgcggtcggatgccgcatctatgaacgcgccgcaaaagtacagccgggccaaaagtggctgaaacgggtcattgccgaaatgggagggaaagatacggtgcttgtagacagagatgctgatcttgatcttgccgcttcctcaatcgtgtattccgccttcggattctcaggccaaaaatgttcagccggttcccgtgcggtcattcatcaggacgtctatgatgaagttgttgaaaaagccgtcgctttaacaaaatcactcaccgtcggaagtccggaagattttgatacatacatggggccagtcatccacgaagcatcttataataaagtcatgaggtatatcgaaatcggcaaaacagaaggaaaactcctgacgggaggcgaaggtgatgactcaaaaggatactttattcagccgaccatttttgcggatgttgatgaaaacgcccgcctgatgcaggaggaaattttcgggccggtcgtcgcgatctcaaaagcccgtgatttcgaccatatgcttgagattgccaataataccgattacggactgacgggcgctctgttatcgaaaacccgcgcgcacattgaacgcgcccgcgaagattttcacgtcgggaatctatacttcaaccgcggctgtacgggagcgattgtcggataccagccgttcggcggctttaatatgtcaggaaccgattcaaaagccggaggacctgactatctgattcttcatatgcaggcaaaaacaacgtctgaagcctattaatctttcggaaatagcgcgatgaaaaagagagtcgcgctattttctctatatgagggtaaggaggatggaacatgtatcagcagctcagcaaaatgcttccggaggagaaaatagaagctattacgaaatcactggtggcgttaaacagcattaacggcacattgggagaaggaaaaaaagccgactatatcaaagatatgatcaagagctttccctactttcaggagaacccgtcacatgtgtgggagcaggcgattcctgaggacccttacggccgcaaaaatattttcgcatttattgagggaaacggcgacagcctgaatacggtcatttatcacgctcatcttgatacggtcggcatcgaggatttcggccctttaaaagatatcgcttttgattccgaccgtctcgcggagtatttctcaaactatgaatttgatcgtgatgtgcagcgggacgcccgctcaggcgagtggatgttcggaaggggttcggttgatatgcagagcggtattgccgttcatctcgccaatctgcttcacttttctgaacggcgcgatcagctgccgggccatattctgttcatggcaaacccggatgaagaaagccagcattccggcattttaaccagcatttctgaattaaaacggctgaaacaagaaaagcagcttcgttatttagcagcgattaataacgacttcatcacgccgctgtatgagggtgacacgacaaggtacatctacacgggcgcggcagggaagcttttgccttgctttgcgatttacgggcgggaggtgcatgtcggagatacgctgtccggcatcgatccgaatttgatcgcgtcagaaatcaccagaagagttcataacaatattcatatggcggaaaacattgagggagagcttgtgcttccgccgacctgcctctaccagcgtgacaacaaggaagcgtataacgtgcagaccgccgtcagcagctatgtctattttaattattttatttacgagaaaaccgccaaagaagtcatggatcagctgactgcggtggctgacgaagcctgcaaagagacagaacgaaaattatctgattattacgacgaatactgtgagagaacgagcctgccgaaaaaagagatgtcatggaacgttcaagtgtacagtctggaagattatctgaaaaggctgagaagccgcgggatagacccggcgcagtgtatcgagcaggcatttaaaacatatgaacatcttgaactgcggatgagatgttttaaagccgtcgaggaactgcaaaaactcgatcctgagcagggagccaaggtcattattttctatgcgccgccttaccttccgcacaattatctgaaggaagagagcacacgggaccggcttttgcaacatgtcattcaagaagccgtcgataaaacagcggcatcaaccggagaaaccttcgcctttaaaaagtttttcccatatttagcggacggaagctttttatcgctgcatgaaacagacgaggaggtctccgcctttaccgataattttccgggctgggatgtcatcgggacgattccttttaaagaaatcagggaattgaatattccgtcggtcaatataggggtatacggaaaggacggccataaatggacggaacgcgtgtacaagccgtacacattccatgtgctgccggagctcattcagcagacgacaatgcaccttttgcacagctaccgattagacatacgcacaaatggctgacataacggaataagggggatgtatatgcagggagataccaatcaaactgaattgcagcgcacgatgaagggccggcatttgtttatgatcgccctcggcggcgtgatcgggacggggctttttctgggctccggttttacgatcagtgaagcggggccgatcggcgcgatattggcttatgtgatcggcggatttttaatgtatctggtgatgctttgtttgggggagctcgcggtcgccatgccggtcgcaggatcatttcaggcgtatgccgcaaagtttctcgggccgtcgacgggttttacgatcggatggatgtacgcattcagctgggccaatacagtggggcttgaactgacgtcggcggggattttaatgcagcggtggtttccggccgttccgatttgggtgtggtgccttgtattcggcgtcgtcattttttccattaacgccctgtctgcgcggagttttgcggaaatggaattttggttttccagcattaaggtcatggccattgtattgtttattattctcggctgcgctgcggtattcggctttgtcggttttaacggcgggcagacggctccgtatctgtcaaactttacgacggacaaagggcttttcccgaacggcgcccaagccgtgctgtttacccttgtcatggtgaatttttcattccagggcaccgagctggtcggaatcgcctcgggagaaagcgaaaatccggaaaagacgcttccccgctccatccgaaacgtcatatggcggacgctgtttttcttcgtgctggcgatgtttgttctcgtgtccattttgccgtaccaaacggcaggcgtcatcgaaagcccgtttgtggctgtgctggataaaatcggcgttccctatgcggctgatatcatgaactttgtcattctgaccgccatgctgtcggtggcgaattccgggctgtacgcttcgtccagaatgatgtggtccctgtcaaaaactaagatgggccccgcttccttaacgaaactgacgaaaaaaggcgtgcctctgaaagctctttccatcaccatcgctatctccggtttatccctgctgacaagtgtattcgcggctgtaacggtgtatgtgtggctcatttccatctccggtatgattaccgtcgtcgcgtggatgtcaatctgcgcttctcaattcgttttccggagacgctttctcgctgaaggaggaaatctgaaagacctggcatttaaaacgcctctttatccgatcgtgccgattctcggattttcggtttacggtcttatcttaatcagtctcatctttattcccgaccagcgtatcggtctgtactgcggcgtcccgctgatgatcatctgttacgcgtattatcacttcggtatcaaaaaacgcctgaagcgtgagccggcttcttcggaaaaaggcgctgccggataagaaaaaaagcccttcgcttaaagcggcgggctttactttgttttccgtttggccgacagcacataggatagaacggcacagaactcaaaaccgaaaatgctgacagccatcggccaggcattttcttctccggcaataccgacaaggggagcggcagccgcacccccgataaagggcaggagtccgagaagagccgcagcgcttcccgcgcctttctcctgtttctgcatagccagagaaaaccccgtcgtcgtgacgatcccgacagaagaaacaatgatgaataaagaaatgcagaccgccgtcaggcctaaaccaaacgcaagtgataaaagcaaagcgatgcttccgatgacggcgatcaacagcccggagacaaacagcttccgttcatcatgtgttttagccatccgtccggtgatttgggtggcgcatatgattcccgcaccgtttacggcgaacagcaggctgaacatttgcgctgatacgccgtagatgttttgcagtacaaacggcgacccggcaatgtatgcgaacatgccgatcatcacaaatgcctggctgagcgcaaatcccataaacatccggtcgccaagcaggccgcgaaacgtcatcagcgtctcccggagtccgccgcttgtccgcttttccggcgggagtgattcaggcaacgccgtaagcacggcggcagaaatgatacagccgatcaccgccagcacgataaatacgattttccagccggcgaactgaaggataaatccccctgtaatcggcgctaaaatcggcgccgccccattgacgagcatcagtaatgagaaaaaagctgtcaattcttttccggaatacatatcgcgtgcggaagcccgtgcgatgacgattccggccgccccggtgaatccttgaataaacctcatgacaattaaaaacgaaacagaagggctgaaggcgcataataaagaagacagcgtataaagcagcaatgacagaatcagcggcttccggcgcccgatcatatcactgagcggcccgacaacgatctgcccgaccgccagccccaaaagacagaacgtcaggctcagctgcgcaagtgacgctgtcgtatgaagatcggccgccacttcaggcaaagcgggcagatacatatcgagcgaaagcggcccgaatgaagcgagcgtcccgagaatcagtaccatgccgaggcctgcgcgggcggcctttgaatcagcgttattcattccatgacccccaccttaacaaatgattctatcactatagcataaccggacggcgtattttatattatttgttgaatataaactaaatattttatttaaaatctgaatgtaaataaaaaatcagaattggttttcatgtgaaatgtaaaatgaaacataaggatgctaaactataaaacaacaaaaggtagaaaagttttacggaagaggtgttcacagagcatgaacagcaaacaaaccgatcacatcgaaacgaaacgccgatttccgatctgtctcgcgcttgctttgacattaggcgtatttgccgcgggttctgaagagctggtgatttctccgctgcttccggatttagcgcgggctttcagctcggatgtcagtgtgctggcgctttccatcagtatttacggagtgatgatttttatcggcgcgccgcttctcgttccgctgggagataaatattcccgggagctcagcctgctggcggggctgcttatatttacggccggcacggtgatctgcgcgctggcgcacaatctctttttcttctttctgggcagggcgctttccgggcttgcggcgggtgcgtttgtgccgacagcttatgcggtggtcggcgaccgtgtgccttatgcgtaccgcggcaaggtgatgggtctgatcgtgtcaagctggtcgctcgctttgattttcggcgttccgatcggctcttttatcggcggcgttttgaattggcggtggacgttttggattttcgccctcatgtctgtcctcgttgcttcgctcattttcattgaggcgcgccgcagtacggaggatggggataaaacagaagaggaaaacggacggcaggcaggcactttccgggatgcgctgaaggtgccccgtgtccctgtatacctcacgatcactttttgcaacatgatcggtttttacggcatgtattcctttctcggcacctatcttcaccgcatgctcccggggggaaatacagcttcagggctgctgatcatggtgtacggaatcggtttttccatgagcgtgttcaccggaaaaatcgcagataaggcggggaaaatgcgctctttgatcgcggcattggccgtgatcagcatatggctttcctgtctcgcctatgcgccgtcatcaatgccgtttttggtcatcgggttattcgtctggggattgatgcaaagcctgacggtgaccttgctcagcaccattttaagtgattgctcacagagccgccggggcaaaatcatggcattttacagcctggcgtccaatttggccgtcaccttgggttctgctgtcatgggtccggtctatgtcggatacggatatgcagctgtcggatttatctgtgcggccgtcaccctcatcggctttgtcctcagcgttttcgcatacagaaggtatgggaaatatgagcatcaggccgaccaatcattgtatcggtaaaataaagtttctataattttgtaaatgttaatttttaacaccttatatcttaaggtgttttttaatatataggaataattatcaatattttcaaataatattgacagcttgaacgtctatggataatatttacttaaaatttaacagattggttggtgctcatgattatattggataatagcattcaaacaaaaagcaaggcttattcaatatctaaactgattacgatcaacacgctcggtcctgaagggacaagcagtgagtacgcagcaaaaaacttcatcaccaattttacccttctccaaggggtgaacagtaaattatcactgcatgatacatttgaatcgtgcattgaaaaaacgcttcaaagtccgctggaatacacaattgtgcctcacgcgtatgacggcattaagcacttctacatgagaccggatctgcagcttctgcaaattttcaggtgcgacaccccgatgtacggcctggctgtccggcccggttttgaatatacggatgacatgcttgataaggctgtcatcgtatcccacccgtctcctatcaatttgattaagtattttacccgtaaagatgtcacgtttgatctggtgaactcaacgagcgcagccgcgaaaagagtgaaggacggtttgtccgacatcgcgctgacaaatgagctggccagacaaaagtacggccttcactttgtcaaaacatttaaaagcattcccatgagctggtcattattcggaaaaggagagattcatgatgaaaactgaacaagatttgcaggaactttatttcccgacgcctaaattaatagaatgggataacggagtaagacaatattcgtccgtcagaggcgatacggaagttctgctttcttacgttccgccgcatacaaacgtggaaccgcatcagcataaggaagtccaaatcggccttgtcgtttccggcgagctgtccatgactgtcggagatgtcacaagaaagatgaccgcgctggaatcagcctatatcgcgcctcctaacgtgcctcacggcgcaagaaatgagacggatcaagaagtgatcgccattgatattaaacgcctgaaagccggtgaaacctacacaagccccgaggactattttttgaatatttttaaaacgagagacttattgcctgggatggaagtcacgttcttcgtggaagactgggtggaaatcatgcttgccaacattccgggcaatggaggagaaatgccgtttcataaacaccgcaatgaacagatcggcatctgcatcggcggcggctatgatatgaccattgaaggctgcaaagtggatatgacattcggtacagcttatttctgcgatccgagagaagatcacggcgccatcaacagatttgaaaaagattcaaaatcagtcaatatctttttccctccgcgctataacagagcaaaagcgaaaaaattagaggcgaaagagtcatgaacctgacggataaaaccgtcctcatcacagggggcgcatcaggcatcggttatgccgcggttcaggcgtttctgaatcaagaggcaaatgtggtcgtcgcggatattgatgagacgcagggagaagcgatgatccggaaagaaaacaatgacaggctgcattttgtccggacggatattacagatgaaccggcatgtcaaaacgccatccggtcagcggttgataagttcggcggattggatgtgttaatcaataacgccggcatcgaaattgtcgccccgattcatgagatggagctgagcgattgggacaaagtgctcaacgtcaatctgacgggcatgtttcttatgagcaagcacgcgctcaagtatatgctcaaaagcggcaagggcaatatcattaacacgtgctccgtcggaggagtcgtcgcatggcccgacattcccgcatataacgcttctaaaggcggcgtattgcagctgacgcgttcgatggccgtcgattacgccaaacacaacatccgtgtcaattgcgtgtgcccgggaatcattgacacacctttgaatgaaaagtcgttccttgaaaacaacgaaggcacgcttgaagaaatcaaaaaagaaaaagcgaaagtcaatccgctgctgagactcggcaagcctgaagaaatagcgaacgtcatgctgtttctcgcttcggatttatcaagctatatgaccggaagcgcgatcaccgcagacggtggatacaccgcacaatagagaaggagtgtttacatatggagagaaaaacagtattggtcattgctgatcttggaggctgcccgccgcacatgttttataaaagcgctgctgaaaaatataacctggtcagctttattccaaggccttttgcaattacagcctctcatgcagctttgattgaaaaatactcggtcgcggtcattaaagataaagactattttaagagtctggctgattttgagcatcccgattcgatttactgggctcatgaagatcatgacaaacctgaggaagaagtagtcgaagaaatcgtcaaggtggccggcatgttcgcggttgacgccattacgaccaacaatgaactgtttatcgctccgatggcaaaagcgtgtgaacgtctcggcctgcggggagcgggcgtacaggccgctgaaaatgccagagataaaaacaaaatgagagccgccttcaaccgggccggcgtcaaatccatcaaaaacaaacgggtgacgacgctggaagatttccgcgccgcgcttcaggaaatcggaacgccgctcattctgaagcctacatatctggcgagctccatcggcgtgacgcttatcaaagagatggaaacggccgaagccgaatttaacagagtcaatgaatacctgaagtcgatcaacgtaccgaaagcggtcacgtttgaagcgccgtttatcgcggaagaatttttgcagggcgagtatgacgactggtacgaaacaagcggttattccgactatatcagcatagaaggcatcatggccgacggggaatacttccccgtcgcgattcatgataaaacaccgcaaatcggattcacggagacatcgcatattacgccgtccatcttggatgatgacgcgaagcggaaaatcgtcgaagcagccaaaaaggcgaatgaaggactcggcctcgaaaactgcgcaacacatacagagattaaattaatgaaaaaccgggaagccggactgattgaatcagcggcacgatttgcgggctggaacatgattccgaatattaaaaaggtcttcggcgtcgatatggcgcagctgttattggatgttctctgtttcggaaaagaagccgatctgccgaaagggttattggagcaggagccatgctatgtcgccgactgccacttgtatcctcagcatttcaaagagaacggccagctgcctgagacggccttcgatttcgtcattgaaagcattgacattcccgccggcgtcttaaagggagacaccgaaatcgtttctttctcagcggccgaggcgggtacatccgtggatctgcggctgttcgaagcgttcaacagcattgcggcgtttgagctgaaaggaagcaattcgggtgacgtggccgaatcaatcaaacaaattcagcagcaggcgaagctgactgcaaagtatgcgttaccggtatgaaacagctgaaaccgaactctaagtatttgcttttcgggcaggcgctttcgtttatgggagactattgcgttctcccggccctgctcattttgtctacatactatcacgactactgggtgacgtctggcgtcatcgcggtccgcagtattccgatggtgtttcagccgtttttaggcgtgctcgtggaccggctcgacagggtgaaaatcatgctgtggacggatgtgatcagaggcgtcatctttttggggctgacatttctcccgaaaggcgaatatccgctgctttttctggcgctgctgtttgtttcttacggaagcggcgtgttttttaacccggcacgtctcgcggtcatgtcgtctttagaagcggatattaaaaatatcaacactttgtttgcaaaagccacgacgatttcgattattgtcggcgctgcagccggcggactttttctgttgggcggttctgtggagcttgccgtcgcgtttaacggggtgacctatcttgtctccgcgtttttcatcagccgcattaagcttcaatacgtgccgattcagtcagaaaacgtgagagaagcttttcagtcgtttaaagaaggcctgaaggaaatcaaaacaaatgcttttgtgttaaacgccatgttcacgatgattacgatggcgcttttgtggggtgtcgtctacagctatttcccgattgtcagccgctttttaggcgacggggaaatcggcaatttcatcctgacgttctgtatcggcttcggcggctttatcggcgccgctcttgtcagcaaatggggctttaacaacaataaagggctgatgtattttacagtgttatcgatcgtctcgcttgcgctgtttttgtttaccccgattttcgccgtgtcagtcattgccgccattcttttctttatcgcaatggaatacggtgaagtgctggcaaaggtcaaagttcaggagaacgcggcgaaccagattcagggccggattttttcggtggcggaggcgtccatcggattgtgcatcgccgtcggttccatgctgatcaacattgtagacgcggcagtcatcatggcgtttatcgtccttttggtcagcgggctgtttctgcatacaaaactggtcaataaatccttttcagaacggaataacgaatcagagcaaattcatttataaggagcctttcagatggaaatcataccgtccgacgtcatcaagacacttccgaaacaggaattttcgctcgtttttcaaaaggtaaaagagatggagaaaacgggagctcagatcattaacctcgggcaggggaatcctgatctccccactccgccgcatatcgttgaaactttgcgggaggctgcgctgaatccttcgtatcacggatacggcccgttcagaggctatccgtttctgaaagaagccatcgcggaattttatgagagagagtacggggtatcggtcaatccggagacagaagtcgcgctgttcggcggagggaaagctggtttgtacgttttgacgcaatgcctgctgaatcccggcgatatcgccttagtcccgaaccccggctaccctgagtatttatcgggcattacaatggccagagcggagctgcatgagatgccgcttcatccggaaaacggctatctgccggattttgagcggattgatcccgccgtcctgaaaaaagccaagctgatgtttttgaattacccgaataacccgactggcgcgactgcggatcaggcgttttatgaaaaagcggcagcgtttgcaaaaaaacatgacatccaccttattcacgattttgcatacggcgcgttcgaatttgatcagaacccggccagctttcttcaggcgaaagaagcgaaaacggtcggcgcggagctttattcattttcgaaaaccttcaatatggcaggctggagaatggcatttgccgtggggaatgagaaaatcattcaggcggtcaatgagtttcaggatcacgtcttcgtcggcatgttcggcggtcttcagcaggcggcagcggcggcgctgtcaggaaatcctgagcataccgagcgtctgaagcgcacatataaagaacggattgactttttcacggcgttatgtgaaaaggaattaggctggagcattgaaaaaccgaaagggactttttatgtctgggctgaaattccgaatgaattcgagtcttcacaccagttttcggactatctgctggagcatgcccatgttgtcgtgacgcccggcgagattttcggcaacggcggaaagcgttatgtcagaatatcaatggtggccaagaagggcgatttgagggaattcgtgctgcggattcaaaagctcggtttgtcctttccttcattacaagaaacatcccgctgagagcgggatgtttttattatatgcttttcatgctgccgccgtcggctgatacttgctgtccggtaatataggaggcttcttcagaggcaagaaaggcagccagcgccgcggtttcttccgcagttccgacacgcttcatcgggacgcctgaggcaatccgttcttccgcttccgctttagaaatgccgttttgcttcatgacattcttcacgaattggtgataacggtctgtggcgataaacccgggattcagacagttgacagtaatgtgaaaaggcgcaagctgaatggcgatgtttttgctggcattaattaaagcggcgttcatcatgctgttggtaaacatattggcgccgggttctttccataggtttccgacgatattaatgattctgccgaattcgtgctgtttcatgattgctgcggccgttttcatagagtcgatataggcgatcgttttattcgtaaaggtatttgtcatatcctctatatcgcagttttcaaaggtatccggcgagccgcccggaatgttgttgatcaatacatcaagccgtccgcattgtgatctgatctcttcaaaaatgccggctctcgccttctggtccgacatatcgccggccagaacggtgacgcccgcatccggatgtttggcgaggatctcttcttttaccgattcgatattttcgggaactcgtgaattaatgacggtatgaaagccattgtccgccagtttcagagcgatcgctttgccgatcccctgactggctcccataataaatgcggttcgttttgacaactgtctgcacccctttaccaaaatggaatctcctttacatcgtaaaaaaaaatgataaaaatagcaaattttatttaaattctgacaaagaaaaaacccgccggacaggcgggtgggtgttacacgtgcaaaaacttcggaagcgtgtcgagagacaagcggtttccgacaaaaaatgaaccgaattcgccgtagcgcgcgctgacttcatcaaagcgcatttcataaacaagctttttgaactgaagcacatcatcgctgaagagcgtgacgccccattcgtaatcgtcaaaaccgacagatcccgtgataatctgtttgactttgccggcatagctccgtccgatcaagccgtggcttctcatcaggtttctgcgttcatccatagaaagcatgtaccagttgtcattgccgcttcttcttttatccatcggatagaagcagacgtatttcgcttcgggcagctcaggatacaggcgggcgcggacatgcggattttcatacggatcgccttctccgcttgccaggtagttgctcagctcaaccacggacacgtaagaataagccgggattgtaaattcagcaagctttgatttgttaaattcaagctcgatttcgttcagctcttccattgtcgggcgaagaatcatcagcatgaaatcagctttctgtccgacgatgctgtagatcgtttgcgagccttttccttctttttcggcgacaccccatttttcaagcagtcccgtaaattcgtgaataatcgacaggcgctcatcgctggataacatcttccatgacgtccagtccattgtgcggaaatcgtgaagcgcgtaccagccgtcaagcgtttgggcggcttcgttcgttttttgctgctcactcatgtatcttcactcctatatcttttcattacattgatgccttcactatatcacagtttaaccgtttcggctgtggagaaaccttgaataatccgaagccttgtgtcagaaactaagccgtgaaacaaaccgtcaattaaattagttagaaaaataagatttctttttgaaagcgctataatagaagttggttatttgaatttagctggaagaagagtatgctgtaaaagtaagcgttttttgtcaacatagaggagggaatatcgtggcagatttatttacaaaagtacaagaaaaagtcgcaggaaaagatgtgaaaatcgtatttcctgaagggttggacgaacgtatcctggttgcggtcaacaacttggcgggcaacaaggtattaaagccgatcgtggtcggcaataaagaagacattcaagcaaaagcgaaagaattaaatcttacgcttgacggcgtggacatttttgacccgcatacatatgaaggcatggaagaactcgttcaggctttcgtagaacgccgcaaaggcaaagcgacggaagaacaggcccgcaaagctttgctggacgaaaactatttcggcacgatgcttgtgtacaaaggtctcgcagacggacttgtcagcggagctgcacattctacagccgatacggtgcgccctgcactgcaaatcattaaaacaaaagaaggcgtgaaaaaaacatcaggcgtcttcatcatggcccgcggtgacgagcagtatgtgttcgctgattgtgcgatcaacattgctcctgacagccaggaccttgccgaaatcgccattgaaagcgccaatacggctcaaatgtttgacattgacccgcgcgttgccatgctcagtttctctacaaaaggatcggcgaaatcagacgagacggacaaagtggctgaagccgtgaaaattgcgaaggaaaaagcgcctgagcttacgcttgacggcgaattccaattcgacgctgcatttgtgccgtctgtcgcggagaaaaaagcgccggactccgacattaaaggagacgcgaatgtatttgtattcccaagccttgaagcaggaaacatcggctacaaaatcgctcagcgcttaggcggctttgaagcggtcggaccgattctgcaaggattgaatatgcctgtaaacgatctttccagaggatgtaatgcggaagacgtctacaatcttgcgttaattacggctgctcaagcgctgtaatccgcaaaagccggcctttacgaggtccggctttttttatagaaagaacgtcactgcggcccagccgaacagggacaaacagagagaaccgatcaagcctgctgcgagcgcccgccagccgctatgacgaaacgccgatatatggactttcaaaccgagacccgccatcgccataccgattaaaacataagacacttgaacaagaaacgcggaaaacgaagctgaaataacgcctgatgtatggatggcgctcattccgagaaatccgaagataaaccaagggatggggagcgaagcggcagaagccgtctttgactttccgctgcggcgcgcccgcattccgagcatgaatgcggccgggacgagcagcgcgacccgggtcagtttgacgatcaccgccatctcgacggctgcttttcctccggcgctgccggccgccgccgcatgcgccacctcgtgaagcgttgccccgcaaaaggctccgtaagccgcaggagaaaagcccaatccatgataagaaagagaatatacaacagtaaaaacggttcctaataacgaaacggcggccgcgctgatggcggctgcattttcatttgatctgatctgcggcgcgatcgcggcaatggcagccgctccgcagatcgctgtgccgcaggctgtcagcgtgctgagtgtctgatctatacggaacagccgggacagtccgtatacaacggcacccgcaaacatcatacagcagacggcaattgcaaatacgtgccagcccgcatgatagatatccgccagattcagtctcataccaagcaggatgatgcctgctttcagcaagtatttgcttgagaacgcgatccccggctctaatgccgcccgctgtccgaatacggcgcgccaaagcatgccgatcagcatggcaaggacaagcattccgaacatatgcaaaaacggcaggcggctgacatagaaagccgcaaacgcaattcctgcggtaactgaaacaccttttaccatcttcatctcagtcacctcccattatcttgataactccactttactgcggtcttaatcattagtaaaatatatttatatgatctaaacgattaggaaaaataatgattaggggcgatgctttttgtattatggggaactgaaaacattcattgccgtcgtggaagaaaaaaactttacaaaggcggcgcagaagctgatgatttctcagccgagcgtcagccttcacattaaaaacctggagaaagaatttcaaaccgccttgctgaaccgctctccgaagcactttacgactacaccgacgggggacattctctatcagcgcgccaagcagatggtctttttgtacgaacaggccaaatccgaaatttacgcccatcatcattatgtcaaagggaagctcaaaatcgccgcgagctttaccatcggcgaatatattctgccgccgcttctcgcaaagcttcataacgagtatcccgaactgaacctggacgtcatgatcggaaacacggaggaggtcagcgaagcggttcggatgcttcaagccgatatcggattaattgaagggcatacggggaaaaacgagctcgacattcagccgtttatggaggatgaattgtgcattgccgcaccgaacggacacccgctcgccggcagaaaaaacatcccggctgccgaattgcaaaatcaagcgtgggtgacaagggagaagggttcgggaacgagggaatatttagaccatgtccttcaatcaaacggactgcggccgaaatccatgatgacgatcagcagcaaccagggcgtcaaagaagccgtgatcagcggaatgggtctttccgttctgtcaaaaagcgtgctgcaaaaggatctgcttcacggcagcatttccgtgcttgagataaaaggattctccttaaaacggaagctgtctatcatccaatcttccattatggagaacacaaaaaacaaagaaatcttcatcgctcttttgaaaagccaatttcaatcatctcaagcggagtgatataataaatgcatggaaagcctatgacgaaagggatttaatatagatgggaaagcaaccgattgatttactgatgcagccgagctggagaatcattgaccaatccagcctcggcccttattttgatgcgaagcagtcattcgcaatggatgatacgctgtgcgcctccgtaggcaaaggggaatcgcctgcgacggcacgctcttgggtgcaccaccggacgatcgtgctcggcattcaggacacacgcctgccgtttttagaggacggcgtgaaattgctggaggacgaaggctaccgtgtcattgtccgcaattcaggaggcctagcggtcgttctcgatgaaggcgtattgaatatctcgcttatttttgaagatgagaaaaaaggcatcgacattgacagaggctacgaggcgatgacagagctggtgcggcggatgctgcgtccgcacaatgctgaaattgaagcatatgaaattaaaggatcgtactgtccgggcagctacgatctcagcatcggcggccgaaaattcgcgggaatctcacaaaggcgcctgcggggcggaaccgcggttcagatttatctctgcgccgataaaagcggaagcgaacgcgccgatctgatcagacgtttctatcaagccgctttaaaagacaaaagcaacgatacaaaaggcgtatatcccgatatccggcccgaaacgatggcttcattaagcgaattgctgctaacggacattaccgtgcaagacttaatgctgatgcttttgactgaactgaaggaactcagcggacgcctgtatgcagccggattatcgccggaagaggaaatggtatttgaaaaaaatctgacccgaatgctggaacggaatgagaaggtgttcggcacgcaggaaagcttggactaagtccgggcttttttgtttttggtaattatatactatttagttatagtgaaaaaagaagtgttgtatgaaaactagtttacattatataccttatttgattaatatatttatgtaggttccaaataattctataaactgaaggagatggagatatgaactttaaaaaaataaaagaagaaaaaagaatcacgatcccgacgcatttgttagccggagatgcggaacaatcaggcaattctttcgcttggagcggctgggtgcttgtagtgccgagccaagaagacaatcaaaacccgaatttgaatttctctgatttagccgctcaaaagtaggataatcactgtttggagcctacacatctgagacgaggcggtgagagtatgacacaagagtatataagagaaattaagcggggagcactgtcatggattgttgaaaatatccattactttgatatgaatcataaagtagcgaatgatttcaggtggcgccttaaaacatttatagaactcatttttcttaccaattacctgatcagaaatcaggcagatgataaggaagttgctgttttaacggagtttattacagaaaggctccgtaatgatcagcttgaagaatttattcattttgatccggacggtctcgccggattggctattgcgggtgaatttcttaccttgactgatcatccgtcacgggcttcggtgatatgggagctggaaaaattcacggcagcgcgttttgattgcagccttgctaaaattccctttcggaaaatggatctgaagtacagtctgcaaagagcaggcgtaacctcggaaataacggatttttctgacttatatcactacacagcagctggtcaggatatcccaaatacatatatgacggatcatgatgcgtacagcatcactcatacgattttttatataacagacatgggatgttcttcgcttacggataaagagtatcatctgccgtccttaaaagaaaaggtcctgaaatttctcgggatctatatctgtcttgagaatttagatattactagtgaattattgatgtgcagctcttttttacatatcgacatggataaggacaaccataaaccgctctatgaagcagcctggaataaaatctatcagggccgaatgaaagaggggaatatcccgagcatcacctatcaacataaacccggtttgaaaggtgaacagcgaagagaagatatattcaaacattgctatcatacaacacttgtcgccgcgggtgccgcgcatgcctgtcttagagcagaaaggaacgattagcttgaacagattagctgaagaggcggatcaatttttattatcttttgctgaacaatcgcttccggatcaaaagagcattcagctgtttgccggcttctgcaaatactacaggaagacgagccattcttccgctgtaaaagaacatactgaaaggattgcctccgctttcgttgataagtcatgctgggaagatctgtttcactgtaacacggccattgtcaatgagttgattcatatctatttaacggcaaaagcttataaaaagaagcagggaatggattcggatgatcaggtcatacgtcacggattgcaaaacggctatcttataaaaaaagaatggccttattttaaatacgccgaattcgctggtttgctgagcgagctgggaatgtcaactgaccatgaaaaagtgcgcttttacaagaattcgatgtttcagcctttgctccatgacgcatggaaaagaacagctgaaaacgagctggagtttgtcgagtactgtcttcttcatttgaatgagggagagcatctgcttcatcccggcttgaaggcgtccattcaaaaatggcttgtgttttgtctcggcagccgaaaaatgaaacagctgtgcaatatgttatttatccaatcgtgtatcgatccatttttttatggctgtcaagcggctcttcatcatataaataacgagaatccatccattcattgtgctccggctcttctgccggcgattgagattctgaatctggagtgtggaacatgcggatagtcaaggaacattttaatataaaaaaaacagaagaatggctgctgggtttttggaagaacattcagctgcagccggaagaaatggaagcagatgatctcatgcacctgttttgcggtttagcggcatgtcatcactttgaaaaaagaaaggatacagaagaagtcattctattcttagaccgttattttggagaaaaaacgcacgaatgccatccggtcctgttcgcgtatgcgtatcatatataccgcaggatggatgccgcaaaaagcatcttttttcataacggacttgaacaaatggtccgcggtttacaagaggaactgaaatcagagccttcctctatgatcctcatggtgttaggggcttattttggggcgatgactccggaagaactgatcgtgttcttagaaaccgtaatgaaacgtgaggccgatttgctcatggcaccgggcggcatccaggaagaacaggcggatgccctttatgccgtcacttatttgcaaatgaaagaattgcagccttttctcacggaatggtacaaaacatcagactttgctttttcaggtttaatgttagccgagtgcagaaagtatcacattgacgccgttgcaaaatacacagccattatgaaatttctccgattcgatgaggcgctttttatacgggaagggcgggaatttctacgctttcagcagcgaagcagcgggagcttcggttatttgaatccattagcgatggaccaaggggcggtcagcggcaaattgctggaccgtcagtatttcctgccgtccgctcattatgccgccgcctctctgtctatgctgtaatgtctctcttttgaaagacggaaaaagaaatcaataaacaaataagaaagtagatcgctataaccgtcacggaataggggatgtttaacgttgaaatcgcatcacccgcgcttttatttacataagcaacgaggtttaaatgcggaaagagcgtaaatttataccacgtatattgggcaagcaaatcagttccgcccaatatactgccggcaaacagcagtaaaatcgataagcagagggagagcgcctggcttttgcacaatactgacaaagtgaacgcaatggtgacaatgcttataattgatatgaaacgcaaaagcagaatgattccggatgctttgattgaactgatggtatacagactgtcatttaaatgagtatagacgagcggatatgaagcattggaaaaaccgaataacacgccgccgatcagcaaacagctcacacagtaaaataagtaaatcataccggtaaacagaagggaggccagaaatttcgatgttaaaatccgccatcttcgattcgggcttgtagcgataaacttaatcgtcccaagggcaaactctttagaaacaaccccgctgacggttaaaatcgcggttaagcttacgaaaatctcaagcccgtttgaagtaaccgtgccgaaaaacctccagccgttccattcataagggttgatgttatgctccaaataatagtctttattcttaacatcagcagaataataaacgcctgtcgtttcagccggtttatcaatttcttcctgctttttttcggcgagaagccgttctttccaattgttatccgaggaagcatctaactcatgattcataataaggccggccagcaaaacgatgagaaacaggaagaaaagagataaaagtgtgcctttttttcgggttatttttatgaattcgttctgcgccagatgaaatatgctcataccgcgtcctcctgatctgtaatcatcatgtatttctcttccaatgacaaagttcttgcagaaacgcgggaaatcagaatctctttctctgccaaagatttaatgacatacgggatggtatcttcttccgcttccaattcaatgacgcggctgtctttttgctgtacttgaagaataccttcccgctctaatatttctttcgcccttgccggatgatcgaccgtgacggtaaacagctttttctgaccaagattatgtctgttcttcatgtcttcaattcctaaaatccgtccctttttaatgtaggcaaccctatcgcaaatctcttccatttccgacaataaatggcttgataataaaatagaaaccccttgcttcgctaaatcagaaagaatggtgcgcaattctttcatacctttaggatcgaggccgttcatcggttcatccagaattaataacccgggattgtgaagaagagaataagcgagccccaagcgctgtttcatgcctaatgagaaatgtttcacttttttgcgggcagcctgatctagtccgacttttgcaagggtattcataaggtcatccgttttcagcgaggtgctccgcagtctggtgaaatatttcaggttttgcaaagcggtcatattcggatacatatccgggccttcaatgataaccccgatatgtctcataaaatattcaaagtcgctgtccggtctgcctctgaatgaaatggctccttctgtttttttaataagctgtacgatcattctgaaaatagtggtttttcctgagccgttcggccctaaaaggccgaatatctcgccttttcttacatcgaaagaaattgactgtacaataggggtatgattgattgttttagagacatcttttaatatcagggctggttcagtcatgatatttgcacaccttccttatgatttagggtaaaagccgtcaaaaccgaagaacatgcttccgatcaggccggcaacgattaaaatgagagcaatgctataccacatttttcgattcaatggtttccctccttacaacgctgacattccatttgaaatagcgcaaaaagatgcggaatatcagtttcgaaagatcaaatccggccataaacaccgccatacccgctccaagaaccatacatccgttaaaaatggctgttacaatcggcacttttacaaggagaaagaatgatccggtcatcagcatcaggccgatcgccatcaaacttaacaccgcaacagaggcaaaaagaaacggtgtcagcataaacatgaagttgaacatgcccatacccagcatcaggccgaatgctttgaaaaaggagcgccatgttttctgctcctcggcatcattgatgaaaatatccgcttttaaggcgcgcgcaagtgttttggggtttcctaaattgccggcgatttgttcatcgctttttccttcagcgccgcccatttggaatatttcgccgatatcggcgagtatctctttttgctcaagttccggcagatcttttatttcccgccggagatgttttaaatattggtctttacacattcattttccctccttaatgatgctgttcactttttcggacaggtcaagccattccgattttaatgtttgatgataaaaggcgccttcttctgttactttgtaatatttgcgtgatgggccttgatcggaagctgctgtatacgtttttaggcagttattttttgtgagtcttcgtaatatggggtagatggtgccctccgatacagggaacgtttcacttatgatcttgattaattcataaccatataaatcttcataaagaagcagggacaacacacaaagttccaacgctccttttcgtaattggctactcatttactatcattcccatcatatctaataattgtattctctatacagtgtattgcacagtagctaatcgatcaataattcccaagaaccatttgggatgaggaattgaatctttatgcttatgtgcgggcggggaccgagatgcgcagcccttgcgggaagaaggcctcctgaacaatgtttacattaatatagatcaggatgcgcgtcattgacaaatggcaaaaacccctttttccatgacaaggaaaggggtttttccgttattcggccattttttctaaattgccgttccggtccattttaaaggacggagaggcatgctcgtcgtcttcaaataaaactagttttctggctctgttcataattttcaccaaggtttcgtagtcttcctgaatggttttttgatctttttcaagcttttcgacggccgcttccagctgctcggttttagactgaagttcttggttttcccgttttaaacggtcattttccatttgcagggcggaagtttgctttccgctgccttcatagctctgcagaaattgaatgacgtctgccattgtgagctccgccttttggctcggctgctgaggcgccagcaaatgtgataaactagctaactcttccttgaagctttcatcgacataaggcatatgttcgccggacatgacggcttgccgatcttcttttggcgcttccgtttgaaccgtctcttcggctgcggtttcctgcatgatgtccgcatccggtgcaggcggctggtataatagtttcttcttggccggctggccgtttccgagcgcgcgcatccgctgtttccgctgttttttggcaagctgaagcgctttttcatattgatggcggacgacagcattccacctgaatccgcacgctgccgacgttctgtttaatttatcgcctacctcttcaaaggcattcagctgcgtgcttccttcccgaacgtgacggagcacggtttccgcaagcagcaggtcattttcctccgaccaggcgtcctgtctttgttttgtcaatgttctcaacccccaatatctttgatggtattagaatgtccagattggaaaatatttatacaaattggctgaaagaatgagagatacgcagagccttgcaggataagatgaatccttgtacaatgagatgtgatgtgatttttttcgtttttaaaattaagatttaacatagaggaacattgaatgaagggaagcgtacatcatggctaatgaattccgagtgtgtgatgattgccaggccaccaatattaagactttgctgccgcgtttgaaagaagctgacccggatgcaaaagtggaggtcggatgtcagtcatattgcgggcccggacgcaaaaaatcgtttgctttcgtaaacaaccgcccgctgtcggcgccgactgaggacgagctgattgagaaagtgaaaaagaagatcaaaaagtaaatgtgtatttttatgacagcctcgcccgatgggtcaggcttttttgcttcaaaaaatcaatgacggaaaactggaacaaaacgccggacaaattcaaggatgttttcaaattacagagccgatataatagaatcacggctaaaaaaaagagggaatgacgatggcgtatccaaacggaaaattatcagaagaaaaagtgtttaaagatcccgttcaccgctatgttcatgtgcgggacaagctgatctgggatttgatcggcacccgtgaatttcagcggctgcgccggatcaaacagctcggtacgacgtatttgacgtttcacggcgcggaacacagccgttttaaccattctctcggcgtctatgagattgtcagacgaatggttgatgatgtttttaaagggcgtcctgaatgggatgacaatgaacgcgaactctgtctcagcgccgcgcttttgcacgatttgggacatgggccgttttcgcattcctttgaaaaggtttttcatctggatcatgaagactatacgagggaaatcattctcggcgacaccgaggtgaatcaggttctcagaaaggcgggaccgggatttccgcaggatgttgctgaagtcattgccaaaacatacaaaaacaagcaggtggtcagcctgatttcgagccagattgacgccgacaggatggattaccttcagcgggacgcatactatacgggcgtcagctacggacattttgatatggaacggattttaagggtgatgcgtccgcgagaggaccagatcgtcattaagcaaagcggcatgcacgccgtcgaagactatattatgagccgctatcaaatgtactggcaggtgtattttcatccagtgacgagaagcgctgaagtcattttgacgaaaattctccaccgtgcgaagcagctccatgaagaagggtatatattcacgcatgctcccgttcatttttattccatttttgaagggaagctgacgcttgcggattatctgaagcttgatgaagccatcattttatattatttccaggcttgggaggaagaagaggacccgattctgtccgacttgtgccgccgcttcattaaccgccagctgtttcaatatgccgaatttaaccccaatgaggaaatgtcggcttattttgaactgaccgctctgtttaaagaggcgggaattgatcccaattattatttagtggtcgattcttcatcggatctgccgtatgatttttaccggccgggtgaagaggaggagcgtctgccgattcacctgttaacgcagaacggccagatcaaagagctgtccaggcagtccgccattgtcgaatccatttcgggcaaacgccggacggaccataagctctactatccgatggacctcatttgtgacgattcagaaaaccctgaagcaaaattaaaaatccggcagctgctgggactgacatagaaggattttggtaaagaaggaaaaggagatgtcgggaatttgttgaaagaacatgcaaaactgatgaaggtgttctcggattctggagaaatcatcgggcggaaaaagctgcagaaaatcatttatatcgcgaagaaaatgcagtatcctttctacgaaaaatatgattttcatttttacggcccgtattccgaagaactgacgcttcgaattgaagagctgtgcaatcttgggtttctggatgaggtgaaggaaaaaaagggcggctactttcaataccggtactcgctgacggagacgggagccgagtttttacatcatgcggagcttacgatgccggatatgaagaagtacatcgacagcgtcaacagccgctcatcccggtttctggagctggtgtctacgattttgtattttgacggccttgaagctgaggaaaagaaagagaaagtgtttacgataaaaagcaaacagaaatatacagatgaagaatatgatgaggcgcttcactacatagaagagctgaaacatatttgttaaaggcgatggctttcgtcttttttgatgaaaaaaccaggccgcgataaagcgggcctggttttgtttattgtctcaatttgctgtgcttgtacgaatataaaaagtaaacgatgacgccgatgatcagccagacggcaaaataaagccacgttttcagcggcagattgaccattaaaaacaaacagcagataatggccaaaatcggcagtactggtacaaaaggcactttaaatccccgcggcagatccttatgggtgcggcgcagaatcagcacggacagactgaccatggcaaatgtcaatagcgcgccgatgtttgagagatccgacagctctttcagatcaacaaaacccgcgatgcaggcgctgatcagtccgatcagccatgtattaaagatcggcgctcccgatttctttccgacaatggtaaagactttcggcagcattccgtctcttgccatcgcaaaagatatacgggtcgccgcatatgtatgggcgagaacgacggccatcagtccgatcaccgcaccggcagcgataacgcccgccaccgcgttttgtccgacagtctgcagcacataagacatggcttccggcacattaagctgtgaatacggaaccatacccgtcatgacgagacagacgatgacgtacaccaatgtacagatcaccagtgaaccgataataccgatcggcaggttgcgctgcggttttttgacttcttcagccgaagcggaaatcgcgtcaaacccgagaaacgcaaaaaagacggcagaagcccctgtaatgacgcctttgattccaaaaggcataaaaggatgccaattgcccggctttacaaaaaagcttcctgtgatgataaacagcaaaacaattccgatttttacgagaaccattacattattaaaggttttgctctccttggagccgcgtgacagaacgacggcaattaatagagtaatgatgatggcaggaaggttgacgatgcccccctggctcggcacgtgcagcagactgtccggcaaaggcatgccgatttcggctaacagattattaaaataacttgaccagccgcttgccaccgccgacgccgtcaccatataaacggataagagcgtccagcccattaaatggccgacaatttctcccatggtggtataagagtaaatataggcgcttccgtaaaccgggagaacagaagcgatttcggcgtaacataatgctgcaaggctgcagacaacggctgcaatgataaaagaaaagattacggaaggtccggcgtttttcgcggccgtaatgcctgtaagaaccatgacgcccgtcccgatgacggcgccgatgcccagtaatgttaaatcaaatccacccatcgttttggcagtctgcctgtttctgctttgttcaagcagctgggtgatgtcttttttttgtaggatattccgcaacacgcatccctccatccaaaagcaaaagccaagagggactctttggcttttacccgtgtcacattctgtgtaatcgacaatcctgtgttctgtttccccgtctgttccgtttcttttccagtcatattgtctgccgcatccgatcagattatcctttctgtcaaacgcagtcacccttaatgattttacctgaatcatgtctataaaaccagcattgcataaaagggatgggtgaaaaagtaggagataatagtctgtatagggcaggataaaagttgcgggctttccggccgaaattttgactttccccgcgaggtatcagtaaaatgtaataaaaaacaatcaaatgatgatggatgcatcttgaaatggggagtttctgcatggagcacgatatattgcaagcaaatgtactggattacgcgctcacgaaatatttaaagagcacgaaaaagcttgatgaggcgacaattccgaagagtataaacaatatcagaggatttattctcaggattatttaccggcacggcacgtgcacgattaaagatatattgcaggaagtcacattatcgccttcagccacgacaaccgctctgaatcatttagaaaaagaaggtttcgtggaaaggtcgagaaataacgaagaccggcgcacggtatggatgacgctttccgaatcgggaaaaatggcggccatgcaaatgattgaaaaccggcagatgctcattgacgagctgttcgaagcattgacagaggaagaaaagaacacctttttcagcctcgttgaaaaagtaatgaaataagccggcctgacatagcagcgccggcagttatcaaggattactccgtatcgctgatccgtttgccggcgacggcgtaatgatcctttctcatttcttcaatcatgacaatgatcttttcttcggctgcgcctgtcgtttcttttacggcttctgtcactttttcaaccagattccgtttttgttcatctgtgcggccttcaagcattttaacggttacgagcggcatggtgctgatcctcctttatcgtttcctctctttggaagagaggtcacttatagtatactgaatgaaggacaatcttgcattttttaaaaaaggggatttttacatttggacagatttttatattatccgctggagcttatgccctatgtcgtgattacgctgatcgtggcatttacgatgcatgaactggcgcacgcgtatgtcgcgtatcggttcggagacgataccgcggcgagacagggcagattaacgctcaatccgattaaacatcttgatgttttcggaacgattctaattttggtcgcgggtttcggctgggcccgtccggtgccggtgaaccgccgcgcctttaaaagaccgcggctggcgggagtgctggtttccgtcgccgggcccgtaagcaacctgtttcttgcctttatcggtttctttttgctagtgttgatgcatgcttacggaatggagctgctttctgcattcagcatggggcttgaccgctttttctctatttggattcagctgaatctcgcgctgtgtttattcaacctgctgccgcttcctccgcttgacggctaccggattattgaggatctcgtgccgccgcgggtgcgcgccaaaatgactcagtttgagagctacgggattatcgtgtttctcgtgctgtttgtaacaccggtcggctcctatgtcgtgtggccgctgttaagcgaggggagagactggattcttaaggtatttgccattatatttcaaccgcttttgtaggagggtattttcatggaagaaaaaaagaagaaaacaatcggatttaatattattaaaagtgatccgaccgacggacatggcggtttcggcgccgggtcgctgagccttgacaatatttctccggtatttgtcgatgtggaagagaaggaagctttcgttgacatcggcgcaatgcatgcccgcagtgtcgttgaaaaaggcatcaaattcctgccgaacaaagatgaagtgccgaacggaaaaccgtactggctcgtgtgggtcaccatcgacagaaaagaagaaggcccttattacgcgggtgtgacggcttgtgaaatgaccgtggacagaagtatccgcagaggctataagtcattgccggagcatgtgaatttaatggataaatcaatgaagcgccgcattatcgtggacaaaatggacgccagctcaaagcaggtgcttgctgaatttctgcagaagcatgaccaagggctctgggaacgttcatccgatgaattgaaaacgggtctgcttccgggcgaaaaataatttgtgaactttttgtgaactttataaatatttgcactatttcgcaattgtactgagtaaactgttgatacagaatcaggacatggaaagtcccgagccgaaccaagactcggggtttttcatgtttacgcggaggtttcatcatgttcaccgtctttgacatcgggccttgggtcattgaagcagatacggcggaaacgagaaaacaatatgaaaaatcatgggctgatccctgcgattgcgggagctgccggaacttttccgaggcggtgaatctccttcccgccgagaaaacaagattgtttaggcagtttgggattcgtccggctgtctgtcacgatttgggggagcatggaaaggaaaacggcctgcatcattatgcgggcagctatccgattgtcggcaggcttagggaaggctggccaaagtttcatatcgagagggcgggagatatccgcttttcgttttcattggcgagtacaacattttttataccgaagggttttcctgaccctattatccatctcgacttttcactcttgctcccatgggtgcttgaggaagacgcggagtaaagcccggcgcgcaatgcaccgggctcagtcttttttgccgagccacttatcccaccactttttgcgcggagcttctttacgggcggggacgtgttccttttcttttttagacggttccggtccgtagcacacatccgcgggctctgtgcctgcgatgaaatacgtataatgctttgcggcgcatccgggtccggaagtgtagccggaagcgggatcgatatagacgcccgtgacgcccttcggcggtttaagcgctatttccggttctccttcgagcgccttctccataaagtccgcccaaatcgtcttcgcatagcttttttcttctactgaatcaatcgtgctgcttttgtcatagcctgtccacacaccggcggcaagagcgggattaaagccgatcatccagctgtctgcgctggtcgtgcctgatttaccgccataggttcgggtcagccggtcagaaatggtgcgtcccgtgacggaagtatagccgtttaaatcctgatcaaacatgcccgtcatcatgctcgccgtcacaaaagcggcttttttatcaagcgtctgctgatgtccgcgcggctgttcatacaagacgttgccggcggtatccgtcacttttgtgataaaggaaggggagatttgttttcccccgtttgcgagcatcgcataggcattaaccatctcaatcgggcgcacgggttcagttccgagtgccagagacggaaggggctttaaatgttcgctgatgccgaattcctttgccgccgacacgagcttattcatgccgagaaagagatgggtcttcacggcatagatgttgtctgataacgcaagcgcctgaagcagcgtaatcggtttattggcgtagtagccgttgtaattgcttggagaataggtatctccgttttcgtcaatctggaactcagtggcttcgcttttcatcagcgtgaccggtgtaaagccgctttgaatcgctttgtagtacaaaagcggcttgatcgtggaagccggctgccgtttcgcctgtgtcgcccggtcaaacgggcttttttcgtagtcacgtccgccgagaagcgcaagcacgcgccctgttgccggatcaatcgcggaaaagccgacctgaatgtcagagccggtacggatcgtatgtgccacagtgttttccgcgatccgctgcatgcgcttatcaagcgttgtataaacacgcaacccgctcgttgcgagctgttcacgcgtcatgccgagctttttctcgagttctttcatcgcatcgtcgtaaaaataaggcgccgttttcgctgcggttctgtttttcagcggctgataggcaagcggcgttttcttaagcctttccgccttttcttttgagatcattttttgtccggccatcagacggagaatggtttcctggcgctgtttggccttcttttcgctgacatatggcgaatagccggacgggcctttcggtatgcccgccaaaagcacggcttccgcatcgttcagatctttggcgtgtttgccgaaatacaggcgggaggcggcttcaattccgtatgcgccgtggccgtaatatatcgtatttacataaccttctaaaatctcgtttttagaatagttctgttcaaggcggatcgtgtaaaatgcttcgttccattttcgtttccatgttttatcatgctcaaggtagagatttctcgcgtattgctgggtgatggtgctggcgccctgaaccttggccattgcctttatgtcagccagcgcggcggcggccatccgccggtaatcaaaaccgtggtgattgtaaaagttttgatcctccaccgcaatcgcggcctgcactgctatcggattgatatcttttaaccggacccagtagcgcttttccccgaaatcggtctcacctagctttgagccgtcatttgcataaagaatcgtagactgaggaacccggacggagggggcgccctgccatttcgctgcaagaagaacggatgtgaagcagacgccggccagcattccgccgatcagtgtcagaaagatgcaggcgcggatgattttgagcgtgattctgagctgttttccagatactttatccacttttgggaaccccctttttcatgattctattattatgtgaaaaaagggggttttttaaacatatccaaccggacacttctttactttttcccctccatcctctatactttttccttaggtgaaaatgagattttaaccggaataaaagcgatacagacgcttacaataaatgaaataagccttgaaagggagatgacaattgagcgagctttggtatacggagaagcagacgaagaatttcggcattacattaaaggtgaaacaaacattacatacggaacagacggaatttcagcatctggaaatggtggagacagaagaattcggcaacatgctgttcttagacggaatggtcatgacttctgaaaaagacgaattcgtctatcatgaaatggttgcgcacgtcccgttatttacgcacccgaatccggaaaacgttctcgttgtcggcggcggagacggcggtgtcatcagagagattctgaagcacccaagcgtaaaaaaagcaacgcttgtcgacattgacggcaaggttattgaatactctaaaaaattccttccgtccattgcgggcaagcttgattatccgcgcgtcgacgtgagagtcgatgacggtttcatgcacatcgcgaaatcagaaaatgagtatgacgtcatcatggttgattcaacagaaccggtcggaccggccgtcaatttgttctcaaaaggcttctatgccggaatttccaaggcgttaaaagaagacggcatcttcgtcgcgcagacggacaacccgtggtttacaccggaactgattacaaacgtacagcgtgacgtgaaagaaatcttcccgatcacccgtctgtatacggctaatatcccgacgtacccgagcggcctgtggacatttacgatcggttctaaaaagtacgatccgcttgaagtggaggacagccgtttctttgacatcgacacgaaatattacacgaaagagcttcacaaagcggcatttgttcttccgaaatttgtgagcgacttaatcaaataaaaacgtacggcgcaggagcgaatcttgcgcttttttacaggaaagcgagggtattattgatgagatttgatgaagcttattcaggaaaagtatttatcgcgagccgccccgactggaaagaggcggacgccatcctttacggcatgccgatggattggacggtcagctaccgtccgggttcacggttcggcccggggagaatccgcgaggtgtctatcggtcttgaagaatacagcccgtacctcgaccgtgacttggctgatttgaatttctttgacgccggagacattccgcttccgttcggcaatccgcaaagaagccttgatatgattgaagaatacgtggacggcatcttagaaaaaggcaagttcccgctcggcatgggaggggagcaccttgtatcatggcctgtcataaaagccatgtataagaagtttccggaccttgccatcattcattttgacgcgcacaccgacctgcgcacggattatgaaggcgaaccgctttcccactctactccgatccgcaaagcggccgagctcatcgggccgcaaaacgtattttcattcggcatccgctccggaatgaaggaagaatttgaatgggcgaaagaaaacggcatgcacatttctaagtttgaagtgcttgagccgttgaaaaaagtgctgccgcagcttgcgggacgcccggtttatgtcacgatcgatatcgacgttcttgaccccgctcatgcgccgggaacgggcacggttgacgcgggaggcatcacgtctaaagaattgctcgcgtccatccatgaaatcgcgcgctcagaggtcagcgtaaaaggcgccgacctcgtagaagtggcaccggtctatgaccactcagaacaaaccgcaaacacggcaagcaagatgatccgtgaaatgctgcttgggtttgtgaaatagaaagaagaaaacccggaataacagggcagaagcagcctttgttccgggttttttgtaatagatattaaaacactcgaggggattgtccccgcaaacctaaaatgaaatctttcataataaattcaaatcatggcgcgttcagaaacataataatgaggagttaagctattcattatccctgctgatactaatatcgtactcacagcaaaacagactataagtaatttatacttcaatttcatataaattcactcctccttcgatctgctgtctggcttcttcaacttttaaaaagtagacagaagcttttttatattcttcttttgtgtaataatatttagctacatcaagggctaattcctcaatatcagcatacatcagtttactttcaagaaaatgcagacaatcgtttattaatgtatctcttggatccggcatatataaatattccaaaaatttaaatttttcctcgtaaattatatcatctatttccttacatattgagataccttttttatgataatcgtacgcattatctatattttctaacttaaaataaatctgtgtaagtaagaagtagggctgcggaagtgaatggctcatttgagctttttcaaaaacagctatggcttcttttaaatggggaatagcctcgactttattgttttgattattatggcataaagcgatgttaaaaagtgttctccccattaattgcggctgctgctccaattcagccatcgtatatgccttttgaaagtgggaaatcgcgtgatcgtattgctttacatcaagataattagccccaaataaagaatggcactgggttaatctaatattgtattttttttcatctttataaattaaataagcctgccgcgcataatccatcgatacataagtttgtttcatataataatagacttctgacattttaaagtaaaattcagctttttctatatgatctttaacgtacgtcagtttgctttcagctttcttaaaaaactgaatcgctgaaagatattcacggcattccagctcatacatcccccggaaaaaattaaaataataatcaagccgtccggtcagccgggcctgctttttatcaatatccgcgagcagatccgatagtctcggctgttcttctatccgctgcgattccagcggttcgaggtattcgagcatcagattgtggcggaattccatgagagaatagtacagatgaagatcctgatcttcttccaggcctgcaagctcttctttgatttctctccgcaagtactcggcgtccgggatgctgaaccttcgaatgtacatataccattcgttgattttttctccaaccgctgaagacgataaaacactcgccactattccgaatccctcccttccacgttatgtatatgacatattttatcattttcattcggaaggatagcgcaaaaataccgcaaacttttcccctttgacaaagccgtccgccgaaggaaccgcatttttcccgcagcccgggatttccggttttttcattttccttaaaaatcatgtttatcttcaaaaccaatcagcaaagatggtaagataggaggaagcggttgaactttttcccttgaaaacttatactattcaggttaagcgggatgatgaaaaggaagtgtcagcatgagacaggagacaccagtagccattcatgtgcaatcattcatacacaacggctcagaagaagagtcggttgaatttacatcgagtggattctattacgtgagaaacggcaaaacgtatctttcctatcacgaagagcatgatttgggcaagattaaaacggtcgtcaagattacagaaaaagagattctcgtgatgagatcgggcgccatccaaatgaaacagcggttcattccgggggcatcgacactcactcaatataaactgccgttcggacaaatggagctccgtacggaaacaaaaaacatacaagctgatgtcggcggttcggaaggctccgtcaaaatgacatataacatgactgtaggcgaaaaccaagaacatgtacataacatgacgatccaatataaggaggaaacaaaggcatgaatattgcggaacaaatgaaggacgtgctgaaggaagagatcaaagcggccgttctgaaagcgggcctggcggacgaaagccagattccaagcgtactgttagaaacgccgaaagacaaaacacacggtgattattccacaaacatggcgatgcagctggcgagaatcgcaaaaaaagcgccgcgccaaatcgctgaggagctcgtggcgtcatttgataaaggcaaagcttccattgaaaagatggatattgcggggcccggctttatcaacttttacatgaacaacagctacttaacaaaactgattccgtccgtgcttgaagcgggtgaacattacggagagacaaacatcggacaaggcgaaaagattcaggtcgaattcgtatcggccaacccgacgggagatcttcacttaggccatgcgcgcggcgcggcggtaggtgacgcgctgtgcagcgtgctttctaaagcgggctatgatgtgagccgtgaatactatattaatgatgcgggcaaccagattaacaacctggcgctttccgttgaagtccgttattttgaagcgctcggcctcgagaaaccgatgccggaagacggttaccgcggcgaggatattatcgccatcgggaaaaagcttgccgaagatttcggcgatcgtttcgtacatgaagaggagagcgaacgtcaggcgtttttccgtgaatacggcttaaagtacgagcttgataaacttcgctccgacctggaaaatttccgcgtgccgtttgacgtatggtattctgaaacgtcactgtacgaaaacggaaaaattgatcaggcgctcgaggcgcttcgcgaaaagggccatgtatacgaagaggacggcgcgacatggttccgctccacaacgttcggcgacgataaagaccgtgtgctgatcaaaaaagacggctcatacacttatctgctgccggatatcgcataccataaagacaaacttgaccgcggattcgacaagctcatcaatgtatggggcgcggatcaccacgggtatattccgcgtatgaaagcggcgattgaagcgctcggttacaagaaaggcacattggaagttgagatcattcagctcgttcatttatacaaaaacggcgaaaaaatgaagatgagcaaacgtacggggaaagccgtaacgatgcgcgacctgattgaagaggtcggccttgacgcggtccgttatttcttcgcgatgcgcagcgctgatacgcacatggattttgacttggatcttgccgtatccacatctaacgaaaaccctgtgtattatgcgcaatacgcacatgcacgtatttgcagcatgcttcgccaaggggaggagcagggacttaaaccggcggcagatcttgatttcggccatattcaatcagaaaaagaatatgacctgctgaaaacaatcggcggcttccctgaggcagtggcagaagcggcggaaaaacgcattcctcaccgtgtcacaaactatatttatgatctggcttccgctctgcacagcttctacaatgcagagaaagtcatcgatccggaaaataaagagaagagccgcgcgcgtctcgctttaatgaaggcgacgcaaattacgctgaacaatgcgcttcagctgatcggcgtatccgctccggaaaaaatgtaatgatgatcaaaggacaaagtcttcgggctttgttcttttttttgcatataaagcgtgtgatgtaattcacaatcccgcacactgagtttttgtatgataagactgatattgaatcagtgaaaggggcaagccgaatgatcaatcgtcaacatattcaattatcgttgcagtcattaagcttagtggcagggtttatggtgtgggtgctgatttcatcgctcatttctcaaatgacatcagatattcatttaagcaaaggcgagatttcattggtgacggcgattcccgttattctcggatcgcttctccgtattcctttaggatatttaacgaacaggtatggcgcgcggctgatgtttatgatcagcttcatcctgcttttgtttcccgtattttggatcagtatcgcggattctttatttgatttaattgcgggcggctttttcttagggatcgggggagcggtattctccatcggagtgacgtccctcccgaaatattatccgaaagaaaagcacggtgtcgtcaatgggatttacggtgccggaaacatcgggaccgccgttactacctttgccgcgccagttatcgctcaagccgcgggatggaatgcaaccgtgcagatgtatcttgttttgctggctgttttcgcattactgcacgttttgttcggcgaccggcatgagaagaaagtcaaagtttccataaagacacaaatgaaagccgtttaccgaaatcatgtgctgtggatgttgagcctgttttattttattacgttcggctcctttgtcgcctttaccatctatcttccgaattttttggttgagcattttgggctgagccctgcggacgccggtctgcggacggccggctttatagcggtctctacgctgctcaggcctgtgggagggtttctggcagataaactgagcccgctccgcattctgatgtttgttttcgcagggcttacgctgtcaggcgtcatgctgtcattctccccggcgatcggcctttatgcgttcggatcgctgacggtggcagtctgctcagggattggaaacgggacggtatttaaactggtgcctttctatttttcgaagcaagcggggattgccaacggtattgtgtctgccatgggcggactgggcggttttttccctccgctgattctggcaagtgtatttcaggcgacaggccaatacgcgatcgggtttatggcgctttcagaggttgcgttagccagctttgtccttgtgatctggatgtattggcaggaaagaatgaaaacacatacggagagaaacagtcatagccttgattcataatgatccattcacaagattgttaattttttctgggtgagtgcaaatcaagtcacgttacaatatacatacgcaacgtgactttcttcgaggtgagctcatgaatattctctctgtccgaaaatctgataaagaacttctttcccgcgaactgcatgaattgctggaatcgatcagtacgaaaaggaaaatgaaaaaacacacgtatttgtttcaagaaggaatggatgcagaagagctttatctgattcaatcaggactcattgaaatcggcaagctgacgtctgacggaaaagacctgacacttagaatctgccagaaacacgatattgtcggggaattgacgctattcacagatgagccgagatatatgctcagtgcgaaagtgttagaggacggggaggtgctcgtcattaataaaaacaagctggaaaaggaattgatccaaaacggtgttttaacgtttgaatttatgaaatggatgagcacccatctgcgaaaaatccagtctaagatcagggatctgcttcttcacggcaaaaagggggcgctctattccacccttatccgcttatcaaacagctacggggtggaacgaagcgacgggattctgattaacattgtgctgacaaatcaggatttggctaagttttgcgcggcggcaagggagagcgtcaaccgcatgctgggagacctccgcaaacaaggggttatttcgatagacgaaaccggaaaaattattttgcacaaacgggactatttacgatgtgagatcgagtgtgaaaattgtccgcttgagatctgcaatattgactgaaaaaacaagggcagccgatgtccttgtttttcagcttgtgatacatatacacatgacggcgaaaaagaagccggcatttacgatttccagaatgccgatcgttttcaccggccagtctcttccatgaaaaaaccaggcccgcagactgcttgggataaaagcgagaaacgcccagcctgccccgagaagggccgataaaaaggggagcaagaggtgatatccccacgaccagtaagcaaaccttctgttttttctctcccttatgaccgatttcacataaaaagaactcccgacaaaaaataaagcggattgcaagaatagaaaccaagcccagccgtcaaggattcccgttcccagccagcagctcgcaagcccgcccgaacaaaagaacagaacacccgcaatatcattcgtaagcgcccgttcgttttttcggcgggcataatgcgtatgtatgagaaacagcggcaataaaaaaacgccgatccagacgagctgcggcttatgaaagacagaaatgatcaaaaagcagcaggccggaaaaccgtaataccatatccacttttgatagggctgaagctgtttctttttcaaagcgagcgaaacgggataaaccgtcaagtaaaggaacagccagcccaaaaagagcggaatatgccagaaaaccgggcctcccttgaccatgccgagtaaaaatggaatcagcagcatcgcccatgcgccgtgctgcttcggaatcatcgctttcatcgaaaccctcctttttatttcattataagtgcaaacactctcctgataagtgacctttatcatacaagctgtgaaatacatcactgccgcgcgggctcaatcgggctacactaaagctatcaatagcacaggaggctttcctatgaatcagtgtgactatttattatttctgaaacaacttcctatgtttaatgaagtgcctctgtccattgtcgaaaccttgctgaaaaacgggacgtttatctgcggctcatctgaccaatctccatcctttcttcactcacaatccgtttatattgtattaaaaggcaatatccgttttacggacagcaggctccctgaagggtcacaaaccgttgcgctgtgggaaaaaggcgatgtgtttccgattgatgaaaaaggcgggctctctttatcgccttttatctcagtcaatgcctcaccggatattctggtactccatattccatattccgtatttaagcaaatgatgtcttaccatccgcggctgcaaatgaactttttggcgatgcttcagcaaaatgtcttctgttcctatcagttgtttttgcggtatctgcatacatcacgggatgaaaacgccgaacccggttcttaaacagaaccggtttttttgatgacgcgggcgtccctatatcgtttgaaaatccttcctgctgctctgtgtgaacgttttgtgaaaaaagcagagtgtgtgacatagttcacaaggtgatgcgccgtctctgtttatagtgtacatagcatcacctgactcggaaggagtgaacgatcatgaagaaaaagaaaatgagtccgttgctcaggagattaaactatttttctcctatcgaacatcattcaaatcatcatagccaaacgacaagcgaagatcgtgattgggagaatgtatacagaaacagatggcagtacgacaaagtcgttcgctccacccacggcgtcaactgcacgggttcttgcagctggaatatttatgtgaaaaacggaattgtcacgtgggaaggacaaaacttgaattatccatcaacaggcccggatatgcctgatttcgaaccgagaggctgtccgcggggggccagtttttcatggtacatctacagcccgctccgtgtgaaatatccatatgtgcgaggtgtgctgatcaatttgtggcgggaagcgttgcaggcgcatcaaaatccgctggatgcctggaaagcgatcgttgaaaaccctgaaaaagcgaagtcttataaacaggcaagagggaaaggcggctttgtccgcgcggaatggccggaagtgctgaagctgatttcagcctctctgctgtatacagtgatgaaatacgggcctgaccggaatgtcggtttttctccgattcccgccatgtccatgatcagccatgcatcaggttcgcgattcatgtctttaatcggcggcccaatgctcagtttttatgactggtatgcggatcttccgccggcgtccccgcaaatttggggcgaccagacggacgttccggaaagcagtgattggtacaattcaggctatatcatcacatggggttccaacgttccgttaacgagaacgcctgacgcgcactttttggcggaggcccgctataaaggcgccaaggtgatttcaatcagtcccgattttgcggagtcctcaaagttcgcggatgactggctcagtatccgccaagggactgacggagccctggcgatggcgatgggtcacgtcattttgcaggaattttacgtgaatcaagagacggaacgtttcattgaatacgcaaagcaatacacggattttccattcctcgtcaccctgtcaaaagaaaatggcgtatacacagcgggacggtttctgcatgcgaaggacatcgggcggcagacaaagcatgatcaatggaagcctgcggtctggaatgaacaaacaaacgaatttgctataccgcaaggaacaatgggctcccgctgggacggacagcaaaaatggaacctgcatatgatcgatgaagacactggggaaccgattgaaccccgtctctccgtgctcggaatagaggacgaaatcggctcggtgcgcattccgtatttttcaaatgacggaaacaaagtgcttgagcgggatcttcctattaaaaaattggatctgaatggtgaagagacgtacgtcacgaccgtgtttgacttgatattggcaaactacggcgtgaaccggggcatcggcggacaatcagccgcatcttatgatgatccccgtccgttcacacctgcctggcaggaacagatcacgggaattaaaagagaagccgttatacagattgccagggagtttgctcaaaatgcgatcgatacagacggcagatcgatgattatcgtaggggcgggaatcaaccactggttcaactccgacacgatttaccgtgcggtgttaaatcttgttttactcgtcggcgcccaaggcgtaaacggcggaggctgggcccattatgtcgggcaggaaaagctccgtccggctgaagggtggcagacgatcgcaaccgcaaaggactgggaaggcgtgcctaaactgcaaaacggcacctcatttttttactttgcgacagaccagtggcgttatgaagaccagccgatcagtgacttggcttcaccgatcgccgcgtcatcccgctacaagcatcacgccgattacaatgtgctggcagcgcgattagggtggctgccgtcctatccgacattcaatcaaaacggcatcaatctgtatcaagaagctgagaaggcgggggcggcgacacctgaagacgtaggtgcgtacgtggcctcacggcttcaagagaaaaaattgaaattcgcgattgaagacccggacaatgaagtgaatttcccaaggaatctcttcgtatggcgggctaatctgatctcaagctcaggaaaagggcatgaatattttctcaagcatctgctggggactacgaacggtctgatgaatgacgacagcgacagcatccgccctgaagaaatcaaatggcgggaacaggcgccggaaggcaagcttgacttgttaatcaatctcgactttcgaatggccggtacggcgctgtattccgatatcgtgctgccggcggcgacatggtatgaaaaacacgatctcagcagcacggatatgcacccgtttattcatccttttgctccggcgatctcggcgccgtgggaatcgaggtcagactgggatattttcaaagcactgtcaaaagccgtttccgacctggcggaagaagtcgagatggagccggtgaaagaggtagtcgcgacgccgctcctccacgacacgatgcaggaattggcccagccgttcggaaaaatcaatgactggagcaagggcgaatgtgaagccattccgggaaaaacgatgccgaacatccatgtcgctgaacgggattacaaacacatttttcataaaatgaccgcgctcggccctcatacggctttaaaaccgagcggaacaaaagggatgagctggtcgatcgccgatgaatatgaatcgctcaaaaagagactgggagaaaccgattcagacggcgttgccaaaggatgcccgaatataagtgaagcaaagcaggcggcagaagcgattttaaccctgtcgtccacctcaaatggaaaggtcgccgtaaaagcatgggaatcgcttgaaaacatcacaaacctgaagctgaaagacctggcggaagaacgcgaggaagaatgctttacgttcgagcaaattacagcccagccgaaaacggtcatcacgtctccggcttttaccggctcagaaaaaggagggcgcagatactcgccgtttacgacgaatgtggaaaaattaatcccgtggcggacgctgacaggcagacaatcctattatgtcgatcatgaactgatgatggaattcggtgaaacgatggcgacatttaaaccgatcctccagcaccgtccgttcctaagcaagcggcctgatcaagagggcaaagagatcgttcttaattatttgacgccgcataataaatggtccgttcacagcatgtattttgattccctgccgatgctgacgctgttccggggcgggccgaccgtgtggatgaataaagatgacgcagaggacacggatatcaaagacaacgattggattgaatgcttcaaccgaaacggcgttgtcgtggcgagagcggttttgtctcaccggattcctaaaggaatggcgtttatgcaccatgcccaggaccgccacatcaacgtgcccggcacaaaactgacgaataaccgcggaggcacccataacagcccgacaaggattcacgtcaagccgacccagatgatcgggggctatgcccagctcagctacggctttaactattacggtccgacagggaaccagcgcgacctgaatgtcgtcatccgcaagctgaaggaggtcgattggcttgaagattaaagcgcaaatcgggatggtcatgaatttggataaatgcatcggctgccacacgtgcagcgtcacctgcaaaaacacgtggacaaaccgttccggtgcggaatatatgtacttcaataatgtagaaacaaagcccggcatcggctacccgaagcaatgggaggaccaggacaaatataaaggcggctggacgttgaaaaaaggaaagcttgaactgaaatcaggcccgaaaacgaatcggcttgcaggccttttctataacccgaaccagccgacgattgatgattactatgaaccttggaactatgattatgaaacattaacaaacagtccgcagaaaaagcaccagccggtggcgcggccgaaatcgtccttgacgggcgattttatgaatatcgaatggggcccgaactgggaggatgatctcgcgggcggccatattacagggcttgaagatccaaacgttcaaaaaatggaggaatcgatcaaaacagaattcgatgaggtctttatgatgtatctgccccgtatttgtgagcactgcatcaatccggcatgcgtgtcatcctgcccgtccggcgccatgtacaaacgtgaggaagacggcatcgtactcgttgatcaaaacgcgtgccgttcatggagatattgcgtctcatcctgtccttataaaaaagtctattttaactggcagacgaacaaagcggaaaaatgcacactctgctttccgcgcttggaggcggggatgccgaccatctgctccgaaacgtgtgtgggcagaatccgctatctcggcgtcatgctgtacgacgcggacaaagtggaggaagcggcctccgttgaaaatgaaaaggatctctaccattctcaactggacgtttttcttgatccgaatgatcctgagattgccaaactggcaaaagaacaaggcatcccggctgaatggatagaggccgcgcagcaatcgccgatctataaaatgatcatcgattggaagattgcgcttccgcttcaccctgagtaccgtacgctgccgatggtttggtacattccgccgctcagcccgattatgaatctctttgaaggaaaaggcagccggcaaacggcggaagctatttttccggctatcgaccaaatgagaattccgattgactatttggcccagctattaacggccggtgatacggatcatattcggtcaacgttaaagaaaatgtctgtcatgcgccagtatatgagggcggttcagacgaataaatccatcgacgcggcactgatctccggtgtcggtttaacagaacagcaaattgaagacatgtatcggctgcttgcgatcgccaaatatgatgaccgctttgtgatcccgagcagccatcgagaagaagtgtcagatttatatgctgaacaagggagctgcggcttatcattttcaggcggccccgggtcctgtttctaattttttataaatgaggtgtaataacatgaacaccacagaccggcaaatcacattctccgctctttcctgtctcctgtcttatccggatgaagagtggagagccgggcttcccgattggaaggctcttatccatgacatcaccaatcagcaaatccgtgagaaactgctgcaatttttcgaggcggcagccaggttttctcgagaagcgctgattgaacactatgtgtatacgttcgatttcggaaaaaaaacgaatatgtacgtcacctactttaactcaggcgaacaaagggaacgcggcatcgaattgctgcatttaaaaaacacctaccagcaatccggtttcctgccgacagagaaagaactgcctgattacctgccgctgatgctggaattcgccgcagttgcggagattgaagcggtgagaagcgtgtttgagaaatacctgtccaatgtgagggagctggcttcccgcctcgaaaaaaatgacagcatctatgctgagctgctgcacgtgctgcaggccgcgctggaaaacatcggtgtacgtgaaagcactgaagaaggggctgttcaggcatgagcgggcagatcctgtgggggattatgccgtacattgtattgacgatctttatcggcgggcatatttaccgctatcagcatgaccaattcggctggacggcgaaatcaagcgagctgttagaaaagaaaaaactcgcggcgggcagcacactttttcattggggactgctgtgcgttgtcggcggacatgtcatgggaattctgatcccggaaggcgtgtatactgcacttggcatttcagagcatacgtatcacaaaatggcgatcggcgctggcctgccggcggggatcgcggcttgtgccggactagtgatcctgacgtacagaaggctgtttgacaaaagaatccgcaaaaccagctcgccatcggatatcctgacgctcatcctgctgctgttcatgatgctgtcaggcgttgcggccacgtttctcaacattgattcgaaaggatttgattacagggcaacagtcgggccgtggttcagggaaattgttttgttccggcctgacgcttctttgatggaaagtgtcccgctatggtttaagtttcatatcatcataggatacgtcttttttatcctctggccgtttacaagattggttcacgtgttcagcctgcccctcaagtatttgacccgcagctatgttgtctatcggaaacgcacgtaaaaatccccctgcaagagggggattttttatggtgagaaaataaaaacataagatattttctgccaaggtaatggctgggcggcggggattcctgttatgttttatttggaaataacctcaacaaaaggagagtgaagaatgaagcggattttcctcattttagccgcctgtctgatgacaagcgccggcgtcctgacactcagacattctcatgtattaaccggcggcacagcgggactgtcactaagcctgtcgtacttgtttcattcctcgtttgcgattatcttctttctgatcaatatcccgttttatatattttctctcatcagaatgggaatcaaattcactctatccaccgtttttgcagtcacagtgctgactctgtttaccggcgcggatcactggctgccgccggtctctgtttcaccgcttgccggggcggtttgcggcggggcgctgatcgggttcggcctgtcgctcatgttttatcatcaggcatcgctcggcggcgccaatatcctcgctttatttctgcaaaagcgctgcggatggaatccgggtgccgttaatttcctcttcgattttggcgtcgtgctggccggcattttttccgtcggattgctgaaagggctcttctccttagtgtcgattgcggtcaccggtctgatcatcggcatcttcaaaaataaaatcaaaggcagctgctcgctcaatccggcattgcttcagaacatcacacccggccagtcacaggaagtgtcatcataagcctttccggctcgtgcggagaggctttttcatatgtttacaggccggaagacagagggtatacagagttatcggatcagatgggagagagtcgggatgctgaaaaggagactggaattttgctttttatatatgatgcttatcggagcatatgtcatatggttttttccggtttccaggcttgagttttacggaggattgctttgctatgcaagcattattttgttcagcatctattcgttaattcttgaaaaccgcacctcgcagcacacgctgttatggattcatattcttgtgttttttccgatcgccgggtacttattttaccttttttccggccagctttatgaaaaaggcaagctgttcaggtcgaaacggacatacaaccgggaaaagctgagaacgatatttgatatggaacagactcccgatctgtccgggctgaaaggaaatcagaagcgtttctttcaatattcaatcaaggcgtcccatatgaatatcaatacaaaaagcaggctgaaggtgctcaaaaacggggacgaaacatttccggagctgtttgaagcgctcaggtcggcagcatcatttatacatattgagtattacatgttcaaatcagacatgctcgggcacaagatgatggagattatgattgaaaaagcgcgtcaaggtgttgaagtgcggtttttgttcgacgcggccggcagcctgaagctggccggaaaagacattaaaaaactgaaacgcgcgggcgtgaacatcgtcccgtttctgccgctgaaatacggttttttcaaccaaaaactcaatttcagaaatcaccgcaagatcgtcatcgttgacgggaaaaccggttttgtcggcgggctgaatgtcggcaaggagtatatcggcaaagaccaaagtgtcggtttttggcgggacacccatatgaaagtcgaaggagaaatcgttcagacgctccacagcatttttatgcttgattgggaatacatttcggatgaggtgctgattgatcagaaagcatacagctgcccggtccctgcagaaagcggcggcgtctatcaagtcgttccgacgggccccgatatgaaggaacggatgagcgatctgtattatgccatgatagcggcggccgaatcatctgtatggatcgcgacgccttatttcgtgccgaatgagccgatccgcacagcgctaaaggaggctgctgccagaggcgtccgggtgcgagtcatggtgccggaaaccaatgacggatttttaacccagtacgcgacgagatcgtatttccccgagcttcttcgcgaaggaatcgaagtctattcctatcaaaaaggctttatgcatcaaaaggtgctcatcactgacggaaacctcgcctctgtcgggacggcgaacatggacatgagaagctttcagctgaactttgaggttaatgtcttttttacagatcaaaaggcgatcaaagatcttgaagcgcattatctggaggatatgagagagtctgagaaaatcagccccgtccgtttctataagcgcacattatgggaaagaacgaaggaatccttcgcgcggttattttccggcgttttataaaaaacgcttttaaaactccttgtgtatagtataattgagaaatattatcattaggaacgaggcacaaggaggacggaatcgtgctgcgacaatttttttcttattataaaccgtacaaaaagctgttttttctcgacttcttttctgccatcgccggcggattgatggagctgagttttcctctgattgttaattactttatcgatacattgctcccggggcgggattggcgtctgattattttgacttccgctgctttattcggagtctacgccctcagctcggcgcttcagtatgttgtgacgtattggggccatatgctcggcattaacattgaaaccgatatgcggaaaaagctttttgaccatctgcaaaagctttcgttcaaattttacgataacaacaaaacgggcagtttaatgtccaagctcaccaatgatttgatgtatatcggagaaaccgcccaccacgggcctgaagacctgtttatcgcggtcatgacgattttgggcgcgttcggtgtgatgctgttcattaactggcagctcgcgctgttgacctttattattatgccggtcgtcatttggcttgctttgtattttaataaaaaaatgacctctgcgtttacaaaactgaacaaagacgtcggagacttcagcgcgagggtcgaaaacaatatcggcggcattcgtcttgttcaggctttcagcaatgaagcgtttgaaacgcagcggtttgacgtgaacaatcagcgtttccgcaaaacaaagctgacgtcatataaaatcatggcgaaaaacggctcgatcagttacatgctgacaagattcgtcacgctgttcgtcctgttgtgcgggacatggttcgtgatccgcggatcgttatcttacggagaattcgtcgcttttgtgctgctgacgaacgttctgttccgtccgattgataaaatcaacgcgattattgagctgtatccgagaggcatagccggttttaaaagctttatagaaataatggaaacggagcctgatatcaaggacgccccgaacgcgagacatgtgtccggtttaaaagggaatatccgttatgatggtgtgtcattcggttacgaagaaaacagtccggttctgtcgggaatcaatttgtccattcatgccggggagacagtcgcattcgtcgggccttcgggagcgggaaaatcaacgctgacaagtctgctgccgcgcttttatgagccgtctgaaggcgtgatttccatcgacggaatcgatattaaggacatgacgctgtcatctctgcgcggacaaatcggcgtcgtccagcaggatgtctttctgttttccggcacattgcgggaaaacattgcttacgggcggctcgatgcgtctgaggaagaaatccggcaggccgtccgccaggcacatttagaggatttggtaaacgggtatcccgacggtttaaacacggtgatcggcgagcgcggcgtgaagctgtcaggcgggcagaagcaacggctttccatcgccagaatgtttttgaaaaacccgtcgatcttaattttagacgaggctacatcagccctcgatacagaaacggaagccgccattcaaaaatcgctgcaagagctgtctgaaggacgcacaacgcttgtgatcgcccatcggctggctacgattaaggatgcggacaggatcgtcgtcgtcacgaaagaaggcatcgctgaacaaggtcatcataaggaactgctggcatccggcggcatgtaccagagactccatcaggcccaattcggcgagctgatacatgaataatggaaaaaggatagacgagcgggggccgggcagcctcctgtctatccttttttatgtagtccgtatttaatgggcttctttttgcgcaggttcgatgatatgtttgaaacggtcaacaagctgcaccgctttctttccttccactacaattaaatattcttgttctttatgagccattctgaacgtttccagctcaatgatatctttgattttgcacattgtttttttagagtagatatacagctcgtggcctcccgtgtggcaaagctgataaagctgaagcatgtttcttaaagtgaacttcttagcggctattttcaaagatgtaatgtttttcatgtattttctcctccgtctgatggtctgttatttcggaaattccccatatgaacgggtgataaacctggttatgccttccacctcagcactccgcccgccaggcgtttaactccgcggatggcgcttaattcttcgacgagccggagcagcgcccggtctttctctttcgcctcaatcataaaatcgatgtccgcatcccattgtctgaaccgctccagcaccggcagaataaaattagcatccacatagtccgcatgactgcgtacggctgattctgattttggcgaggagagatggaccttcggctttaagccgatccgctgccatgttttgatcatccgcggaagaatgtcatctaaatcagcgtcatcggccggattggcgtaaaaatggtgataatcaaacacaaacggaatgccttcttgctcacatacactgagtgtttcctcggacgtatatgttttatcatcgttttctaaagtcatccgctgtttgatgacatcgggaagttctttcagattcacgcggaaacggccaagcgcgctttgtttgtcaccgtaagcgcctccgacatggatgttgatgacggaacggtccgcgatgcccattgcgtccagcatgtcataatgataggccatatccttgaccgcatttgcggtaatctcccgtttcgggcttgtaaaaagcgtgaattggttcggatgaaagctcgttctgaggtcatattttctgaccagcccgccgatctcacgaaactcctggcgaaacggcgtgacaaaatcccacagtacatccgggtgcgtggcgagcggcacaattgagcttgagaacctgtataaagggatgccgtggccgaccacatagtggagggtgcgcagcgtattggtaagatttgctttcgtcacagaaagcagggcgtctttccgctcactgcgggaaagcttggtatagcgcgcatatgttaaggttttggcgggggacgcgtcccaaaggcacatggcgtttgcgacgaatccgaatctgaacagcatatggtttctcctttataaaaagtaagatatggcctttcccagccattctgcaggaagctgtctgacggagcgctgtttcactttttctaatgtgagaagctcggatttttcgatgtcctgctttatggttgaaagcacttcctttgtaaaggcttcatcatgaatgatgacattcacctcttcattccagaacaggctccgtttatcaaaattcggcgtgccgataatgctgatgcggtcatctataatgaaggctttaacatgataaaagccttgataataccgatagatgaggcagccggccttcagaagctcgggataataggctaaagctgtttcccgaacgagcgggtgatctgatttcatcggaacgatcaagatgactttgacgccttttcggcaggctgaaataagcgcttcctgaagctttttgctcggtacataataaggcgtgccgatgatgatttttttctccgccttacggatgcagctttcataatgcgattcaagcgaaaaaccgtcagatgcatatgtcctatgagagatattcccttcggataatgccggataaaccccgggtgattcgggtgtttttccggtgtttcgtttcaggtcgcttacaaaaagcgtctgaagatccgccgtgccttcgccggtcatccgcaggtgataatcctcccagtttccgaacttcgcttttttgccgaggtactcttcagcgatattaaagccgccgacatagccgattttgccgtcaatgacggtcactttccggtgattccgtttttgcagcctgaaaaaaagaaacggaaatgccggtttatttagaaaatgaacgtgaacgccggcttttttcatcgtttgaatggaaggctttttcacttggcggctgcctgcccaatcgagcagcagatatacggagacgccggcccgggccttttctttcaataaatcaaacatctcatggctgacttggtcgttcttcataataaaaaacatcatatgaatagaagagacggcttggcggatatcagccgtcatctgctgcacaagctcgcttccgcagtgaatgagtgtgatattactctttttcgggtcaaaaacgggctcatacgcctgttttttgtacgccgcccggccaagcagcatatcaaacagcataagtgcgatcaatatgataaaaatgacaagcaacacaaaaatgaccttcataccgacgctcctttccgaagtatccgtagtgtgccctgagaatgtgaatttaattattgactgaacactcattcattatttatgataaagtaaagatatgacaatgaagaggggtatcagaacaaagggggagacaagatgaacgcatttctcatggtaaacgcgctgctgttttcagctgtaaccgcttacgccgtttatttattcgtttacctgatcagaacgaggatcgcttatattaagctcggccaaagggaagaatttgataaacgcctgaaagaacgtcttcagaagatatgggtgaatgtgttcggacagaaaaaattgctgaaagataaaaagagcggaatcatccacgttctgtttttttacggttttatactcgttcagttcggcgcaattgattttattctgaaagggttgctacctgaccgtcatctgccgctcggtccgctttatccggcgtttactttttttcaggaaatcgtcacgtttctgattttaatcgccgtagtctgggcgttttaccggcgctacattgaaaaactcgtcagactgaaacgcgggtttaaagcggggcttgtcctgctgtttatcggcggactgatggtgacggtgcttctcgggaacgccatgaaccttttatggcacgatcattctctgtcttggacggaaccgatcgcttcctccattgcgtttgtgctcggcggtctttcagcgccggcggccgccgccatgttttatgtttcatggtggcttcatctgttgtttttgctcagctttttagtgtacgtgccgcaatcaaagcatgcgcacttaattgcgggtccggcgaatgtgttcctcagcaggctggattcaaaaggtaagctggaaaaaatcgattttaccgatgagacgaaagaaagctacggcgtcggaaagattgaagacttccgccgctctcagcttgtcgacctttacgcctgcgtcgaatgcggccgctgtacaaatatgtgtccggcctccggtacgggcaagatgctctcgccgatggacctcattttaaagctcagagaccatttgacggaaaaaggcgctgccgtgacgtcaaaatctccgtgggtgcccgcgcccgtttttcagcacacgaaggcgaatcagctcgccgcggcttcctcagggggaggatcgcgtgaagcggccgcagccattgattacaacccgagcttaatcggcgaggtcatcacggaagaggagatttgggcgtgcaccacttgccgcaactgtgaagatcaatgtccggtcatgaatgaacacgttgataaaattatcgatctgcgccgctatcttgtgcttacggaagggaagatggacagcgacgcgcagcgggccatgacaagcattgaaagacagggaaacccgtggggcttaaaccggaaagagcgggagaactggcgggagcaggccgatacagagattccgacagtgaaagaaatgaaaaaacaagacaaagagttcgactatttgttttgggtcggctcaatgggttcctacgacaacaggagccaaaagattgccgtctcatttgcaaagctgcttaatgaagcgggcgtatcctttgcgattctcggcaataaggaaaaaaactcaggcgatacgccgcgccgtttgggcaacgagtttctgttccaagagctggcggaacacaacatcggcgaatttgaaaaacacggaatcaaaaaaatcgtcacgattgatccgcacgcctataatatgttcaaaaatgaatatcctgatttcggattccgggccgaagtctatcatcatactgaattattagccgagcttgtgtcacaggggaaactaaaaccgcttcacccggtgaatgaaacgattaccttccatgactcgtgctatttaggaagatacaatgaagtgtatgagccgccgagagcgatcttaaaagccattccgggcgttcaattgaaggaaatggagcgcagccgcgaaaacgggatgtgctgcggcgccgggggagggctcatgtggatggaagaagaaacgggagcgagaatcaacacggcccggactgagcaggcgctttctgtcagtccgacggtcatcagttccggatgtccttactgtctgaccatgctcggcgacggtacgaaagcgaaagaagccgaagacgcgatcggcacttatgatgtcagtgaattgctcgccatgtctgtattcggcgctgaaaaacaagagtctttatagaaagaagcgggccgccggcgcatatgccggcggctttgttttcgcacatcagccgatttatgaagggacggctctaaaatttcttaaattacgctgttaagggtagcatattctgttttaatttgtttataatgagaggtatggtttatgaacaaaacaatacaaattcgttcttattataggatagaaacagatacatataagtaatagaaagggagtgtccgaccttgagtatcaaacaatattctcaggaacagctgaagcagatggctttagttgaaatcgctcacgaaattttctcagaacataaaaaaccggttccgttccaggagctgctgaatgaaatgatctccttgctcggtgttacgaaagaggaactgggcgaccgtatcgcccaattttatacagacctgaacattgacggccgctttattgctctgtcagaccagacgtgggggcttcgcagctggtatccgtacgatcagctggacgaagaaacacagccgactgtaaaagcgaaaaagaaaaaagcgaaaaaagccgttgaggaagatctcgaccttgatgaattcgaggaagttgacgaagatgacatcgatctcgatgaaatagaagaagatattgaccttgaagcagacagctttgacgacgaagatatcgatgaagaagatgacgacgagcttgagatcgaagacgagatgattgaagaagatgaggaagattatgatgatgaggaagaggatcgcaaagactgattttatatcagcaaaacgatcttgactttcattgtcgaactatgtagtatgtattttgggctcttcaaaaagaagagaattcataagagtgctacgctccctttcaagaaattgaaagggagctttcttattttcatctcccaaattcttttacacatcatttgtttttagtgaaatgattttctataaaacggcacattttaaggaatgtagcgcagaccgaagagaggagcaaacgaaatgacgaaatatatttttgtaaccgggggagttgtatcatcactcggaaaaggaattgtggctgcgtcactcggccgccttttgaaaaacagaggcatgagcgtcaccatccaaaaatttgacccttatatcaacgttgacccgggaacgatgagcccgtaccagcacggtgaggtattcgttaccgatgacggcgccgagactgaccttgacttagggcattatgagcggttcattgacattaatctgaacagattcagcaacgtgacgaccggtaaaatctattctgccgtattgaaaaaagagcgccgcggggactacctcggcggaacggttcaggtcattccgcacatcacaaatgaactgaaagaccgcgtgtaccgtgcaggcaaagaaacaaacgcagatgtagtcattactgagatcggcggaacagtgggagacatcgaatcccttccgttccttgaagccatccgtcaaatgaaaagcgacatcggccatgaaaacgtgatgtacattcactgtacgcttgttccgtacatcaaagcggcgggcgagctgaaaacaaaaccgacgcagcacagcgtaaaagagctgagaagcctcggtattcagcctaatatcatcgtcgtgcgcacggaaatgccgatttctcaagatatgaaagataaaatcgcgctcttctgcgatattgacacgaaagcggtcatcgagtgcgaagatgcggacaacctttactccatcccgcttaaccttcaggagcagggactcgataagcttgtctgcgatcatatgaaattagaatgcaaagacccggatatgacggaatggaaagaccttgtcacgaaagtgaaaaacttgtctaaaaccattacaatcagcctcgtcggtaaatacgtcgagcttcaggacgcttacatttcagtcgttgaatcactgcgccacgccggctatgcgtttgacgctgatgtgaagatcaaatggattaacgccgaacaagtgacagaaagcaatattcaagagctgactggcggcacagacggaatcatcgtgcccggcggtttcggagaccgcggcgtagaagggaaaatcatcgccgccaagtatgcgcgtgagaataaaattccgttcttcggcatctgcctcggtatgcagattgcatccattgaatatgcgcgaaacgtattaggtctggaaggggctcactctgcggagatcgatccgtccactccttatccgatcatcgaccttctgccagaacaaaaagatgtcgaggatcttggaggaacgcttcgtctcggactgtacccttgtaagcttcaggaagacacgaaagccttcgaagcgtatgcggatgaagtggtatacgaacgccaccgccaccgttatgaattcaacaacgaatacagacagcaaatggaagagaacggttttgtgttctcaggcacaagccctgacggccgtcttgtggaaatcatcgagctgaaagaccatccttggtatgtcgcttgccagttccaccctgagttcaaatcaagaccgacaagacctcagcctttattcaaagactttatcggcgcttccgtacaagctgcagaacagaagtaataaaaaaagacttgcctcctttaaaagcggcaagtcttttttctgcatcaggcatattcctgcatcatttcctttaacgtaaaggacagtgcgtgatagacatacaggcctgtcattaatgaaggaaagccgtatcttgtcccgtcttcatcaggcagaagcggcatttttaatttgctgtcaatatgaacatcacaaaattcctcaatcccggtttgatctttgatgacaggagatacgcaaacgaggccgacccctttttcataaagcttttgagccagcgtctgttcttcagctgtgcccggacctgaacaaaacatcagcaccctgtcgctttctgtaaccgaatcagctgtatccggaaacgctttgacggaaggcatcggttctgagccgagttccgcctcgcacaaaatgccctgcatctcatttgcgccgtataaataaatggtatgaccgctgacggctgcctgcgccagcaggcgcgcgccgtcttctattgcttcggattccttatcctgaatgcgggaaaaaatgcctgcaagctgggtcgtaaatatctttaacatgagtgaaacctcctttacacatacaagaacagtatacaacaaaagagaaaatgctcagaaaatgtcggaaagtagactattataattaaaggaaatgtgaaaatcaaacagaatacataaacaactgcttccttttgacgaaaatgataatattggggtgtaaaatgatgaatgaaaagattttaatcgtagatgaccaatacggtatacgcatattgctcaatgaagtgtttcataaagaagggtaccagacgtttcaggccgccaacggcatacaggcgctggacatcgtaacgaaagaacggcccgatctcgtgcttttagatatgaaaatccccggcatggacggaatcgaaattctcaagcgcatgaagatgattgacgaatccatccgcgtcattatcatgaccgcttacggagaactcgatatgattaaggaatcaaaagagctcggagcgctgacccattttgcgaaaccttttgacattgatgagatcagagacgcggtgaaaaagtatttacctctaaaatcgaattaataaaattagaaacaattatgtcattgtgttgccgatttgtcgaaaagttggtatcctagagatggagaaaaagcgatctgttgttttacatatgacaggtttttatggtcatgctataggtggaaagcttttttcgagaagaagcaaatcaggctacataaggaggactttcgacatgcctttagtttcaatgacggaaatgttgaatacagctaaagaaaaaggatatgctgttggacaatttaacttaaataaccttgagttcactcaagctattttacaagcagcagaagaggaaaaatccccggttattcttggtgtttcagaaggcgcgggacgctacatgggcggcttcaaaacagtggttgccatggttaaagctcttatggaagaatacaaagtgacagttcctgtcgccattcacttagaccacggttcaagctttgaatcttgtgcgaaagcgattcatgcaggcttcacttctgtaatgatcgacgcatctcaccacccgtttgaggaaaacgtagcaactacagctaaagtggttgagcttgctcatttccacggcgtttcagttgaagctgagcttggaactgtaggcggacaggaagatgacgtgatcgctgaaggcgtaatctatgctgaccctaaagagtgtcaagaacttgtagagcgcactggcatcgactgccttgcacctgcactgggttctgttcacggcccttacaaaggcgaaccgaacctcggcttcaaagaaatggaagatatcggcaaatcaaccggccttccattagtacttcacggcggtacaggaattccgactgccgacattaaaaaatcaatctcacttggtacggctaaaatcaacgtaaacactgaaaaccaaatttcttctgcaaaagctgtccgcgaaacattggcagctaagccgaacgaatacgatcctcgtaaatatcttggacctgctcgtgaagcgatcaaagaaacggttatcggcaaaatgcgtgagttcggttcttcaaaccaagcttaatccaatgtaacatccataaaccgcctgacagcattgacaggcggttttatgtcttacctttagaaagcgcaatcatgttttacagttctgaaaatttattactggggaggctttccttatgttatttttcattgatacagcaaacattgacgagattaaagaagcttatgaacttggcgttcttgccggagttacgacaaaccctagtttagtggcgaaagaagctgacgtgtctttccatgacagacttcgtgagattacggaagtcgtgagcggatcagtaagcgcggaagtcatttccctgaatgctgaagaaatgattgaagaaggtaaagaacttgcgaaaatcgcaccgaatatcacggtgaaaatcccgatgacgtctgaagggttaaaagccgtaaaagcgctgagcgatctgaacattaaaacaaacgtaacgctcatcttcagcgccaaccaggcgcttttggcggcaagagccggagcgacttatgtatctccgttcttaggccgtctggatgatatcggccataacggtcttgaactgatttcagaaataagacagatttttgacattcatgacattgatacacaaatcatcgcagcttccatccgtcatgcgcagcacgtgactgaagccgctttacgcggtgcgcatatcggtacgatgccgctgaaagtcattcaccagctggcgaaacatccgttaacggataaaggcatcgagcaattcttggcagactggaataaataaagataaatagggcggcaaaccggttgcatccgtttgccgcacccttatgttttcctgtttggcagcgggccttcagtatcaaagtgaagagtgtgtttcccccggaatgtgaacccggcgggcctctgtgcatcctgtgttaaaaatgccccgcaaagcttcgctattttcttcctgttattttataatgtccttgtattctttctcttcgaattggctacattttggacaagagctttatttgcagagacagaataaaatgccattttatttagggctccgcagctatcttcttatggaaggagactatcatggaaaagttgaatattgccggcggcgatccgttaaacggaaccgtacatatcagcggtgcgaaaaacagcgccgtcgcattgatacccgcaaccattctggcaaattccgaagtaacgatcgaagggcttccggagatctcagatattgaaacgctgcgtgacctgctgaaagaaatcggcggaaacgtccattttgaaaaaggagaaatggtcgtcgacccttccccgatgatcagcatgccgcttcccaacggcaaagtgaaaaaactccgcgcttcctattacttaatgggcgcgatgctgggccgcttcaaacaggcggtcatcggactgccgggcgggtgccatctcgggccgcggccgattgaccagcacatcaaagggtttgaagcgcttggggcggaagtcaccaatgaacaaggcgcgatttatctgcgcgccgaaaggctgagaggcgcacggatttatttagatgtcgtcagcgtcggagcgacgatcaatatcatgcttgccgctgtactggctgaaggtaaaaccgtgatagaaaacgccgccaaggaacctgagattattgatgttgccacattgctcaccagcatgggcgcaaagatcaaaggcgcgggaaccaatgtaatcagaatcgacggcgtaaaagagctgcacggatgcaggcatacgatcattccggacagaattgaggcgggcacctttatgatcgccggcgccgcgatggggaaagaagtcattattgataatgtcataccgactcacctggagtctttaacggcgaagctcagggaaatgggttttcgcattgagacgagtgacgatcagcttcttatgctcggcgggcagaagcagataaaaccggtcgacgtaaaaacgcttgtttacccgggatttccgactgatcttcagcagccgatgacatctctgttgacgagagccagcggcacgagcgtcgtaaccgacaccatctactcggcccgatttaaacatatagatgagctgagacggatgggggccaacatgaaagtggaaggcaggtcggccattatcaccggtccggccgaacttcagggcgcaaaagtaaaggcgagcgatctgcgtgcaggcgcttgtctggtcgtcgccgggctcatggctgacggcgtaaccgaaattaccggtctcgagcatttagaccgcggctacagcaatcttgagaaaaaactcgaaggtctgggcgccacaatctggcggcaaaggctgacggacgaagagatagaacagctccaaaattcatagaaatgcggacttttgagaggagatcgtgttgaaatggaaagaagcttatcgatggaattggttcgagtcactgaagcggcggctttagcatctgccagatggatgggccgcgggaaaaaagatgaagctgatgatgcggcgacaagcgcaatgcgtgacgtgtttgacacggtgccgatgaaaggcacggtcgtgatcggggaaggcgagatggatgaagcgccgatgctttacatcggcgaaaagctcggaaacggatacggcccgcgcgtcgatgtcgccgtcgatcctcttgaaggcacaaacatcgtagcgagcggcggctggaatgctctgacggtgatcgcggtcgccgaccatggaacactgctgaacgccccggatatgtatatggaaaaaatcgcggtcggtcccgaagcggtaggctgcatcgatatcgaagcgcctgtcattgataacttaaaagccgttgcgaaagcgaaaaacaaagacattgaagatgtcgtggcaaccattttaaatcgtgacagacatgaaaaaatcatctctgaattgcgtgaggcgggcgccagaatcaaactgatcaacgacggtgatgtcgcgggcgccatcaatacggcctttgaccatacgggagtagatattcttttcggttcaggcggggctcctgaaggcgtactgtctgccgttgcgttaaaagcgctaggcggcgaaatcatcggcaggcttctgccgcaaagtgcggaagagcaggcgcgctgtgagagaatgggccttgatgtatccaaagttctccggatggaggaccttgtgagaggggatgacgccatttttgccgcaacgggcgtcacggacggagagctgctgaaaggcgttcagttcaaaggctccgtcggcacgactgaaagcctggtcatccgggcgaaatcaggaacggtccgattcgttgacggaagacacagcctgaagaaaaaaccaaatcttgtgatccggccataaatagagaaaagcgggacggaaagtcccgcttttcttttgcaaaaaagagtcaaccctatcatttatatgtcaaagcattatttaagttgaataattttttgaaatgaggtaaaaataaagagtgctgcgatttttctgtgtcattccttcttttgagtactgggaaattttcaaattctaccgcatacagacgatataaatattgatcttctcaagtttttgtcctcgcttccttcaaaactcattaagacattccttttttaaaaaagcgccgatcatgggtggaagtgttaccgatagaagttcctgaacgttttataaaagaatgtgctttggcggaatcatgcgaagcagccgatttgaatgaaaacagcaatacattgactatgaaaagcgtggtgtttttatgaaagacgtatctatttcctctttggaaaatatgaaattaaaagaactatatgaactggccagacattataaaatctcctactacagcaaactgactaaaaaagaattaatctttgccattctgaaagccaacgccgagcaggaggatcttctgtttatggaaggcgtgctcgaaatcatccaatcggaaggattcggcttcctcagaccgattaattactcgccgagctcagaagacatctacatttctgcttcccagatccgccgctttgatttaagaaacggtgacaaagtatccggcaaggtgcgtccgccgaaagaaaacgaacgctattacggacttttgcacgttgaagcggtaaatggagacgatccggaatctgcgaaagagcgcgttcattttcccgcgctgacaccgctttatccggaccgccaaatggtgcttgagacgaaaccgaattatctctcaacaagaattctcgatatgatggctcccgtcggtttcggccagcgcggtctgatcgtggcgccgccgaaagccggtaaaaccatgctgttaaaagaaatcgctaacagcattacgacaaatcagcctgacgctgaattgatcgttctcttaattgatgaaagaccggaagaagtaacggatattgaacgttccgtagcgggcgatgtcgtcagctcgacgttcgatgaagtgccggaaaatcacattaaggtagcggagcttgtgcttgaacgggcgatgcgtctcgttgaacacaaaaaagacgttatcattctgatggacagcattacccgcctggcacgggcctacaacctcgttatcccgccaagcggacgtacgctttccggcgggattgacccggctgcgttccatcgtccgaagcgctttttcggtgccgcgagaaacattgaagagggcggcagcctgaccattttggcgacggcgctcgttgacacgggctcccggatggatgacgtcatctacgaagagtttaaaggaacgggcaacatggagcttcaccttgaccgttctcttgcggaaagacggattttcccggcgatcgatatccgccgctccggcacgcggaaggaagagctgctcgtgccgaaagagcatcttgaccgtctatgggcaatccgcaaatcgatgtctgattctccggacttcgcagagaagtttatgagaaaaatgaaaaaaacaaaaacgaatcaggaattcttcgatctgatcaaccaagaatggaagcaggcaaacctttcatcatcagcccgccgctgataaaaaatgtatttgcaaatgcagtaaatgactgatataattctctcatatgcgttccggattcgctccggaataataactctgtttccacacgggattcagggcggaaggagatggatacaatgaaagcaggaattcatcctaatttcaaaaaagcaacagttaaatgcgcttgcggaaatgaatttgaaacaggctcagtaaaagaagaggtacgcgttgagatttgctctgaatgccacccattctacactggacgtcaaaaattcgcttctgctgatggtcgtgttgatcgctttaacaaaaaatacggtcttaagtaataatagattttacaggcaggcaagaattgcttcttgcctgttttttatgtccataaacaggaaaaaaaggggagcggatagcctatgtacataatgaagcaaagcggatggcttgagctgatatgcggcagcatgttctctgggaaatcagaagagctgatccgcagagtgaaaagagcgacttatgcgaagcaggaggtcaaggtgttcaaacctgccattgataatcgctacagtgaggaggccgtcgtttctcacaacggcacatccatgacaagccacgtcatctcgtcttcggctgaaatatgggatcatatcagtgaaagcacggacgtcatcgcggtagatgaagtgcagtttttcggcgaatcgatcatcggcgacttatcctcgcttgcggataaaggctatcgtgtcatcgcggccggacttgatatggatttccggggagagccgttcggcgtggtgccgaatctgatggcggttgccgaatcagtgatgaagctgcaggcggtctgctccgtttgcgggtcgccggcaagccgtacgcagcgtttgattgacgggaagcccgcttcctatgatgatccggtcattttagtcggcgcgtcggagtcatacgaagcgagatgcagacatcatcacgaagtgccgaaaaaacagactgataaataacccttttcatgaaaacatcggtaaaaaatccggtgtttttttgacggtttttcaaaaattgtagttaattaacttaaaaaagagtatgaaaaaattaagtaattttcatctcttgaattttcatttttacagacataaaatgactaagtaatgtaaatagttatgagacattgttcgaataattgtcaaaaaaagatatagcagatcgcgatcacactagccaaaatgggtaattacttaactttgttaactatttgaagaaagaaggagattttcttgaataatattaaagtaacgaaggaaggcaacttagaaactactttaagaggaaaagaagttctatctatccctactttaaataaaggtgttgcgttttcagcagaagaaagaaaaagccttggattagacgggctgcttcctccgaccattctgtctcttgatgagcaggcaaaacgcgcatacgagcagtttcaagctcagccggaccgccttcgccaaaacgtgtatttgaatgatttgcaaaaccgtaacgaagttcttttctttaaattgcttcaaaaccatcttcgtgaaatgctgccggttgtttacacaccgactgtcggtgaagcgattcaagaatacagccatgagtacagaagacctcaagggatttacctttctatcgacaacgtggaaggaatcgaagaggcatttgaaaaccttcatgccactgccggagatattgatctgatcgttgcgacagactcagaaagcatcctcggaatcggtgactggggtgtaggcggtatcaacatcgccatcggtaaattagccgtatacacagcggctgccggtattgacccaagccgtgttattcctgtcgttcttgacgtcggtacgaacaacgaaaaacttctgaacgatcctttatacatcggtaaccgccatgaacgtatccaaggcgaacgttatgaagctttcattgacgcttatgtaaaagctgcgcttaaatatttccctaaagctcttcttcactgggaagaccttggaaacaaaaacgcgcgcaatatcatgaagaaatacaaccatgaaattcttacattcaacgacgacattcaaggaacaggcgcgattacgcttgcaggtgtgcttgcggctatgaagaaaacaggcgcgtctattaaagaccagcgtgtggttgtcttcggtgcgggatctgccggaatcggaatcgctgaccaaatccgcgacactatggtgcttgccggtctttctgaagaagaagccaacaaagcgttctacacaatggactacagaggcttgttaattgaaggtatggaaaacattcttgatttccaagagccgtacctgcgcacagctgaagaaattaaagattggaaacgcgatgaaaacggacaaattcctttcattgaagtgatccgtcaagcgaaaccgacaatcttaatcggtacatcaggccaaagcggcgcgttcagtgaagaaatcgtcaaagaaatggcaaaacacgttgagcgtccggtcatcatgccgatgtctaacccgacaccgcttgctgaagccgttcctagcgatctattcaaatggactgacggcaaagtgcttgtggcgacaggaagcccgtttgacaatgtagagtacaatggcgtttctcatgaaatcggacaatctaacaacgcattcgcgttccctggacttggtctcggttcaatcgttgtagaagcgaaagtgattactcctgcaatgtttgcggcaactgctgacgcaatcgcagaaagcgttgattttgaaacaccgggtgcaggccttctgccgagcatgagcgacttacaagaagtttcaattaaagttgcgatcgccgtagcggaaactgccattaaagaaggcgtggcaaaccgcattcctgagaatgtagaacatgccgttcttgatgcaatgtggaaaccgcaatataaacaagttatcgctaaataatttttacgattaattttacagtccgagggaaagcttttatgtaaaggctaaagtatacggacattaaggatttggaggagaatattttgagcttcttagatattttaatcctcctggcgccgatctttttcgtgatcgtgctgggatggttcgcaggtcgcttcggaagttatgacgcgaagtcagcaaaaggggtaagcaccttagttacgaagtacgcgcttccggcgcattttatcgcaagtattttaaccacttcaagaagtgcgtttttatcacaggttcctttgatgatcgctttgatcattgggattgtcggattctttatcgtcattctgttggtttgcaaatttatcttcaagtatgatttaacgaattcatctgtattttctttaaactctgcacagccgacatttgcatttatgggtattccggtactcggaagcttattcggagcaaacgaagtagcgattcctatcgccgttacgggtatcgtggttaatgccatccttgacccgcttgcgatcattatcgctactgtcggagagtcatctaagaaacaagacagcgaaaacgagaacttctggaaaatgactggtaagtctattcttcacggtctttccgaaccgcttgcggctgcaccgcttatcagtatcattcttgtgcttttcggtgtaagtcttcctgagctgggcgacaaaatgcttgaacagctcggcagcacaacatcaggtgttgcgctcttcgccgtcggtgtaactgtcggtatccgcaacattaagctcagtctgccggctttcggtatcgctttgttaaaagttgccgttcagcctgcactgatgtacctgatcgctcttgcagtcggacttccggctgaccagatcacaaaagcggtattgcttgttgcattccctggatctgcggtagcggcgatgattgccacacgtttcgaaaaacaagaggaagaaactgcgtctgcgttcgtaatcagtgcgattttatctttgatctcactgccgatcatcattgcgctgaccgcataataaaaagctccctgtttcagggagcttttttgattagaattgaaatttaaaaggtgaaaatctggttttttttctggatttcttatgttctgaagaagcggctgtttctgagaggggagctgtctgggcaagttcctggatgcgggaggccaatgtctgcaattcggcattgaggtcgtcgatttcccgcctgtgctgaagaagctgatatgagaccccttcatccgctttttgtttcagctggcgttccagctcttctattcttgaaagcagatggttcccgtcctgtttctctttcgtgagaacatccagtttgcgctccagctctgccaacctttgttcagcgccgccagtgattttcggacgctgcaaaatgaagcccgtccgttttttcggctgccggggcacttgaacgtccagaagggcagtgccttcagaaatttgccgtttgaccgatttcagcacatcaagatcctcaggtgtaaaggaataatgtccgagctcattccgttcagccggaagattcagctgcttgacccacctttgcaccgtttttgcggagacgccgagctctttcgcggccatgtttgtattcatgatcacatacctcctttttgctaggtattcgaccatgaggcggcgttcccttcacgttagacaaaacaagaaggaattcgccaaagaaagcggcatttcttcaaaaaacgttacgcttcatacaattcaagcggaagcttgtcgggatcgaagaaaaaggtaaaccgtttccccgtcagcggatcggttctgatcggttctgtgccgacgcccttttcctttaactccctgacggctgcttcaagatcgtttacggtgaaggcgagatgccggagacccgcggcttccggtctggtcggccgttcgggcggatcgggaaaggaaaacaattcaatcgcgtacgcgccgtccagcgccagatcaagtttataagatccgcgatcctttcggtatgtttcttttataatgccgaaaccgagaatctcggtgtaaaaagctttcgacttttcataatcagagcatatgattgctatatggtggatggatttcagcatatccgcccctccttttttgcttcagtataacagaggcgaattgcttttgactggcgataagccctatactataatgagaatgttacgcacaggaaaacagaggtgaagaccgtgttagaccgtttacagtcaattgaacaacgatacgaaaaattaaatgagcttttaagtgatccggaagtggtcaacgatccgaaaaagcttagagaatattcgaaagagcaatctgatatacaagaaaccgttgaagtctatagacaatacagagacgcatcagaacagcttgccgatgcgaaagcgatgcttgaggaaaagcttgatgccgatatgagagaaatggtgaaggaagaaatctccgaactgcagggagagacggaaaccttatcagagcgtttgaaagtgctcctcatcccgaaagacccgaacgatgacaaaaacgtaatcatggagatccgcggagcagcgggaggagaagaagccgcgctgtttgcgggaaatctctacagaatgtactcccgttatgccgaaatccaaggctggaagactgaagtcatggaagcaaacgtgaccggaacgggcggttacaaagaaatcatctttatgattacgggaaaaggcgcatactccaagctgaagtatgaaaatggcgcgcaccgcgtacagcgtgttccggaaacggaatcaggcggccgtattcatacatccacggcgacggtggcgtgtcttcctgaagcggaagaagtagaagtggacatccacgaaaaagacatccgcgtcgatacattcgcatcaagcggaccgggcggacaaagcgtaaacacgacgatgtcggccgtacgcctgacgcatttaccgaccggtgtcgtcgtatcctgtcaggatgaaaaatctcagattaaaaacaaagaaaaagcgatgaaggtgctccgcgccagaatctatgacaaattccagcaggaagctcaggctgaatatgatcagacccgcaaatcagccgtcggttcaggcgaccgttccgagcgtatccgcacatacaatttcccgcaaaaccgtgtgacggatcaccgcatcggcctgacgattcaaaagctggatcaaatcctggaaggcaagcttgatgaagtggttgaagcgttaatcgtagaagaccagtcaagcaagctccagcaggcggaaaattaagatgaagaccgtttttgaagccctaagctgggcttcttcttatttaaccgaagcgggaagagaaaaaaacgcggccgagctgctgctgttaaatgataccggaatggatcggagcaaacttctcgcaagtctgcaggagcccgtcggcgaggacgagctttatcgattcagacggcacgtggagatgcataaagaaggtattccgattcaatatattatcgggaaagaacagttttacggcagggaattttttgtgaatgacgatgttctcattccgcgtccggagacggaagaagtcgtctttcatctgctggacagacagaagcgggcattttccgaggcagaacgcctgaacgtcattgatatcggtacggggagcggagccattgcggtgacgctcgcccttgaatgcggacatttttcagtatcggcttcggatatttcaaaagaagcgctgcaggtggcggaaagaaatgcgcaaaacctcggagcgggcgtgtgttttttgcagggagatctgttaactccttttatttcatcaggaaaaaaagcggatattattgtttccaatccgccgtatatttctgaagaagaaatggcggatttgtcggatatcgtccgtttccatgagccgcttcatgctcttacggacggcggtgacggtttgaaattctacaagcggtttatggaggagctgcctcttgtcatgaaagataaagcgcttgtcgtctttgaaatcggatataatcagggaaaagccgtgaaagacctgttccgtcattcctttccgaatgcggaagtggaagtcgtacaggacatcaacggaaaagacagaaccgtatccgcggtcatcacatcatgaaaaaagcccgccggtgacgcacacggcgggcttttgttacaatggaaagaaaatgaaaggggcatccgccttgaaaaaagcgttcgccttcggatgtatactcgccgccgcagcttatgcggcggggtttgttctgccgtttggctttggcatcattttcggcgccgttacggctgttcttatcgtcacagcgatcatcgtttccgggttggccgtaagcggagcggagcagcgggccaattatcattctgaaacagaagaaggacggcacgcccgtttaaagatggccgccgttttcttttgcgccgctctcccttcagccggctgtctgctgattacgcttctgtagccggattttgtctttgcagcaatacggaatcccatacccaatagacgacggctgttaaaaccgcaaagatataaaaggctgaattagaaaacagagattggcctgacggctgcaaaagaccgaagatgatcccgtttgcaatgaatgacacccctaaataataaagaaaatacagcggatgaaatctcttcggctttttattcagaaagtattgaagcggcagcgcaaaaatcaaataaggaaacaaaaaataaaacgccatcgaaatgaaagccgcgataatgaattgatgaacatacaaaatagaataaatgacagacatacatgccgccgacagcagcacggtgtaattatatttcatctgaaaacctcctatcaaaataatatcgtaccatattttgaatctgtcaatgcagattatcagcttgctagatttttttcttcccgccggtttaaaccttttccgtcatgtccataatgggactagataaaaaaagcacggagaggaacggtggggaccgatgaaacagacgatgatgatctgcatatatatttttcttttattatcaggagcgcttgcgggtttgacaaaagaagaaacagcgcgggcatcagccgatgagcccgtcgtcataccggatgaagcgatccggctcaggattttggccaacagtgataacgatgaggatcaaaagctcaagcgccagatcagagatgctgtaaacaagcaaatcacggactgggtgaaagatatcacttccattgaagaagcgcggcggctcattcgttcgaagcttcctgaaattaaagaaatcgccaaacaaacgatgaaagaaaagggtgcgcatcaatccgtttcagttcaattcaataaaatctcgtttccgacaaagctgtacggcaatatggtctatccggccggaaaatatgaagcgattttaattacactcggcaatggcgagggcgccaactggtggtgcgtcttgtttccgccgctgtgcttccttgatttctcaaacggcgaagcggtgaaagatcaggaagacggcggacagaagcaggaagaaacgcagaaacagactaaaaaagtgctggatgacgtaaaagcaaaggctgataaagcgaagaaagaaaagaaagatgacgatgatacggaagtgaagtttttcctcgtcgattggatttcagatctattttcctgaagcaaaaggcataaatccggattcgattcatagattggaagaaagagttgatcgaaacggagggaaatatatgttttatcagctgagagtggcaagagatcaagatacggaggcgctggaggcctttttgaaaaaggctgatacggcacatgcggaaatcgatcagcagatcagccgttttatcgtgctggaagacagtgaaaaaaagattgccgcctgtctcgggatcgaaaaattcagcggcggaaaagggcttctccgttcactcgtcatgtcggacaggctgaatcaaagccatatcgttacactgtttcaaagtatggatgtgctgtgcaaaaaacatgagattcaagatgtctacttagtcgccaatcagccctcatccgctgagtttctgaatgtgatgggatttgaagcgtgcgccaatgcgcctgatgaactgtatacgtccgaacatttccgcaattcgttatgcacagaaggttcgtttttaatggtgaaaacctctgcctgatctaacttatacacaaggttatccacttattaaaaagtgttgtccacagtttgtggataacacttgttttattaaaggacatcttttatactttcaaaaggaatacacgagagaaaataaagttttaccgctttaaaataaggagtttggttatacatgaaaacaagaagatggtttgtggattgttccgcagaattatccacaaccgatccccagattacacaagccgcggaattgctccggcagaatgaggttgtggcttttccgacagaaaccgtttacggactgggcgctaacgctgaaaatacggaagccgtaacgaaaatatatgaggcgaaaggaaggccgagcgataatccgctgattgtgcatatatcccacatcagccagcttgatcgttttatcagccatattcctgagacggcgaaaaagcttatggagctattctggccgggggcgctgacccttgtcttgccgtgtaagcccggtgtgctgtcaccccgtgtcaccgcgggacttgagacggtagctgtcagaatgcctgatcatccggcagcattagccctcatcagctcggccggactgccgatcgcagcgccgagcgccaatttatcaggaaaaccgagcccgacgaaggccgagcatgtagctcatgatttaaacggccgcattgccggtattgtggacggcggcgcgacgggaatcggagtggaatcaaccgttctgtcctgtacggggaaacagcccgtgctgcttcgtccgggcggcgtgacaaaagagcagattgaatccgccgccggtccggttcttgtggataaagggctgaccgaagaagatgaggttcctatttctccgggtatgaaatatacacattacgcgccttctgcgccgatggctattgccgacggcggcgcccggagaattcaagaactggcagacacatataaaagccgggggaaacgaatcggcattctgacaacagaagagaacgccgatagttaccaggctgattatatcaaggtctgcggcagacgcgccgaccttgaaacagtggcgtccgccttatacgatgcgctccgcagctttgatgaagcggaagtggacatgattatttctgagtcctttccggataccggagtggggctcgccattatgaacaggctgatgaaagccgcaggcggcaccgttatccattaacttgttctaccccttatcggacatgcataagctaaacaagcgggcacgtccaagggggtttttatttcatgtcgaatctattcatcggggaacttgtctccttaagcatcatggcatttgctttggggacggatgccttttccgtcgggctcgggatgggaatgattcagctgaagaaaaaacagatttttcatataggggttgtcatcgggctgtttcatgtcatgatgccgcttacgggaatggcggccgggcatctgctgtccggttttctggggatgctcgccgtttacatcggcggatctcttctcttcattttaggggtgcagatgatcattgccgcgtttaaacaatcagacgggccgctcatatctccggcaggctcgggactgttgctgtttgcggtcggcgtcagtctggacagcttttctgtcgggctcagtctcgggatgaacggctccaatccgtttctggccgttacgctgttcggtgtcttcagcaccgttttaacatgggcgggccttttggctggaagaaaggtgcagtcgtggctcggctcctacagcgaagcgcttggcggagccattttgatcggattcgggctgaaactgcttttaccgatataagatacgtaaaaaaagaaacgaagatgccgtttcttttttcttcatttataataggcagtaagaggtgacggacatgaaaataatctttgtatgtacaggcaatacgtgccgcagtcctatggctgaggctctttttaaatccattgcagaaacgaaagggctggatgtcagcgtaagctcggccggcgtattcgcgtctccgcacggaaaagcgtcggcccatgccgtagaagcgctgtttgaaaaacggatcgctctcaatcacagttcatctcccctatcggaagaacatatcgagacggctgatctggtgctggcgatgactgaacagcacaaacagctgattgaaggccgatatcaaaacagtcagggcaaagtctttaccattaaagaatacgtaacgggggaaaacggcgatatctctgacccgttcggcggtccgcttgatgtttataaacagacgcgggacgaactggaggagctgctgacccttttggctgatcaattgcttgacagaaaaagcaagtaatctgtcagaaaatctgcaaacaggtcatttgcaaaacgaatgtgaaagagtagaatgaaatcaacggatttcgtaataaaaaggacaagcacactgggctgtcttcgcccagccacacctaggaggtaaatgaatgaaagtagctattgcgtcagatcacggcggcgtccatatccgcgaagaaataaaaagtcttttggatgaattgcagattgaatacattgatatgggctgtgaatgcggcgccggctctgtcgattattcagactacgcttttccggtagcggaaaaagtggtgaacggcgaagctgacaggggaattttaatttgcggcacaggcatcggcatgagcatctccgcaaataaggtaaagggcatacgctgtgcgcttgcccatgacaccttcagcgcaaaagcgacgcgtgaacacaatgacacgaatgttcttgcgatgggcgaacgcgtcatcggcccggggctggcgcgcgaaatcgcaaaagtctggctgacgactgaatttacgggcggccgccacgaacggcggatcggcaaaatcgcagattacgaagaaaaaaatctgtaagaggtgctggacaatggaagagatgaagcaaaaatggacggacatgctgactgagtttcaagagcaggcaggactgacggacggcagtctgctggtgatcgggtgcagtacaagtgaagccgccggaagccggatcggcaccgccggaagcggggattgggctgaattgatatacggcggacttaaccggtttaaggaaaaaacgggtgtgcatcttgcttttcaatgctgcgagcatttaaacagggcgcttgtcattgaagcggaaacggccgagcggttcaggctccccattgtttcagccgtccccgtcccgaaagcgggcggagcgatggcctcttatgcataccggcagatgcgttctcccgtgctcgctgaatcgattcaggctgacgccgggattgacatcggtgatacgttcatcggcatgcatctgaaacccgttgccgtccctgtccggatatcaagccgtgagcttggagaagcacatgtgacgatggcccggacaaggccgaagctgataggcggaattcgcgccgtttatgaatgcgaatgatgaaaatacttttcctgtataatgttcgtgttttctaattaaattttgtgatttttttaaataagctgttacattcacctgaaaaaccatgtacaataagggtggtaaaaataaagaacaggaaacggataggagaggatctcgctgatgaaacatttacctgtacaagacaaacaagtgtttaacgccatcaaagatgagcgtaagcgtcaacagactaagatcgaattaattgcttctgaaaacttcgtgacggaagcggtaatggaagcgcaaggctctgttttaacaaacaaatatgctgaaggctaccccggcaaacgctactacggcggctgtgagcatgttgatgtcgttgaggacatcgcccgcgaccgcgcgaaagagattttcggagctgagcatgtaaacgttcagccgcactcaggcgctcaagcgaacatggctgtttacttcacgattttagagcacggcgacacggtgctcgggatgaacctctcccacggcggccacttaacacacggaagcccggttaatttcagcggcgttcaatacaactttgtagaatacggtgtcgataaagacacgcaatatatagattatgaagatgtgcgtgaaaaagcgctggcgcataagccgaaactcatcgttgccggagcgagcgcgtacccccgcacgatcgactttaaaaaattccgcgaaatcgctgatgaagtcggcgcttacttcatggtagacatggcgcatatcgcgggtcttgtcgcagccggtcttcatccgaatccggttccttacgctgactttgtaacgacaacgactcacaaaacacttcgcggaccccgcggaggaatgatcctttgccgtgaagagttcggcaaaaagattgataaatccattttcccgggaatccaaggcggaccgcttatgcatgtcatcgcggccaaagccgtttctttcggagaagtgcttgaagatgatttcaaaacatatgcgcaaaacgtcatctcgaacgcgaagcgcctggctgagtctctgaacaaagagggcattcagctcgtatcaggcggaacggataaccaccttgtgcttgtcgacctccgttctctcggtctgaccggaaaagtcgctgaacacgttcttgatgaaatcggcattacatctaataaaaacgcgatcccttacgatccggaaaaaccgttcgtcacaagcggaatccgtctcggtacggcagctgtgacaagccgcggctttgacggtgacgcgcttgaagaagtcggcgccatcatcggcctcgcgctgaaaaatcatgaagacgaagcaaaacttgaagaagcgagacagcgcgtatctgccttgactgaaaagtttcctttatataaagaactggactattaataaggaagaaacccgccggaaccttaatccggcgggtttttttatgattttcttgaaactgtttgtctttttctgtagaatcaatagaagtgtgaaaaagtcactcggacaacaaaaaaggagctgaacacagtatgggaaaggtttacgtatttgatcatcctttaatccagcataagctgacatatattcggaatgaaaatacaggcacaaaggatttcagagacctggtggacgaagtcgcatcactgatggcgtttgaaattacacgtgatcttcctcttaaagaagtggaagtgaaaacacctgttcaaacagcgacatccaaagtgatttcagggaagaaactcggtatcgtgccgatcctgagagcgggtctcggaatggttgacggcatgctgaaattaatcccggccgctaaagtgggacatgtcggattataccgtgatccggaaaccttaaaaccggtggaatactatgtcaagcttccttctgatgtagaagaacgcgaatttattgtcgtggatccgatgcttgctacgggaggctctgcggtggaagcgataaacagcctgaaaaagcgcggcgcgagaaacattcgttttatgtgtcttgtagcggctccggaaggcgtggaagagcttatgaaacatcattctgacgttgatatttatatcgccgcccttgatgaaaaactgaatgaaaaaggctatatcgttccgggcctcggggacgcgggtgacagactgtacggaaccaaataaatcggaaaacctcattcaggggttttctttttttatccagatatttgctgaatgggcagagttcatacatttataggtgaatttgtgaacattctgtgtatgcttccggtataaaaagttttttaactttaaacagattgacacatgttaggggctattgtatgctaaacgagggtattatgagaaggttttcattcctttcatttctagtatccatcctcattttaaatcctccaaaaaacccgttatatgaggatttatctaagcgaatgaaacagcatcccgtggcatcaggaggatgagtggttttttcgaacaggccgttttgcggacaaaaaaggccttctgcaagggttaaccgcatgttttgccgtatccaggaattatattacattttcatcaggagacagatagttgatggacgatcccaatcttacattcagcagacaacggagatatgtatttgtaatcttagcaatctatttgctgggatatggtcttacggcgtataaaactgtttttttaggcctctttttgggaactgttttcagtttgtttaatttgtggctcttgaccagaagaatgaatgcttttgacaaggccgtggcgaaaggaaagtccatacgatcactcgggagcgcagcgcgttggtgcaatgcgatacttgcgatggctgtcgcctttaaatatcccgataaagtcagtgtggcaagtgtgattattggattaatgacaatttatcccgtcattatgatagattccattattcagctcaaacgttcatcaatggaagagaggtgaaaacccattgaatcacgattacagaactattgatttgtttggtcttacttttaatctgacaaacattctgatgattactgtggcaagtgtgattgtgctgctgattgcgattctcactacgagaacgctgtctatccgtccgggaaaagcccagaacttcatggaatggattgttgattttgtccgcaatattataggcagtacaatggatttaaaaacaggggctaacttcttggcgcttggtgtaaccttgctgatgtacatatttgtatcaaatatgctggggctgccgttttctgtaacggtcggacacgagctttggtggaaatcaccgacggccgatccggctattactctgactctagccgttatggttgtgtcgttaacgcactattacggcgtgaagatgaaaggtttgaaggaatactctaaggattacctcagaccggttccgcttatgttcccgatgaagattattgaggagtttgcgaatacgctgacactcggacttcgtctttacggtaacattttcgccggggaaattcttcttggcctgcttgcgaatctggcgacgaatttctactcaaacagcttctttctcggtttggtcggcacagtcggagccattcttccgatgcttgcatggcaggcgttcagcttgttcatcgggaccatccaggcatttatctttacgatgctgacgatggtgtacatgtcacacaaaatcagtcatgatcattaaaatcatatatccattcggataacattttaaaggaggaactttttcatgaatttaatagcagctgcaattgcaatcggtttaggcgcacttggtgcaggtattggtaacggtctgatcgtttcacgtacggtagagggaatcgcccgtcagccggaagcaggaaaagaacttagaactcttatgttcatgggtatcgcattggttgaggcccttccgattatcgctgtcgttatcgcgttcttagcgttctttggctaagcaaaaaagccttatatgaactaaaaatggcgaagatcactctaagagaaccttcgccattgctttatgtctgataagcaggccgtcccgaaacggctttttatcagcagagaaaacctgcagaagggagttgccgtagtagatgtctcaattacctcttgaattaggactgtcgtttaacggcggagatatcctattccaattgttagctatgttagttttattagcgcttctcaagaaattcgctcttggaccgctattaaatataatgaaacagcgtgaagatcatatcgccggcgaaattacgtccgctgaagaaagaaataaagaagcgcagaagctgattgaagagcagcgcgttcttttaaaagaagcgaaacaggaatcacaatcactcattgaaaatgcgaaaaaactgggtgaaaagcagaaggaagacattatccaggctgcacgcgccgagtctgaaagattgaaagaagcggcgagaaccgaaattgtcaaagaaaaagaacaagcggtttccgcacttcgcgagcaagtcgcatcactttctgtcttaatcgcatcgaaagtgattgaaaaagagcttgatgaacaagcccaggaacaactgattcaggactatcttaaagaggtaggagaaagccgatgagtggatctgctgtctctaaacgatacgcgtcagcgcttttcgacattgccgttgagacttctcaaatcaatgaaatcgaagaagagcttaccgtactaaaagaagtgttccggaacgaagccggattacaggaagtgttaagccatccgaaggtatcggccgctaagaaaaaagagctgattcagcaatcgttcggcgcactgtctgagtctgtgctgcatacgatttttcttctgattgaccgccgccggtcttcgattgtgcctgatctcacagacgagtttatcaaacttgccaatcaggcccgtcagacagaggacgcggttgtttattcagtaaaaccgctgtcagaagcggaaatgttatcattgtctcaagtgtttgcaaaaaaagccggaatcgcttcgctcagaatcagaaatgaagtgcagacggatttaataggcggcattaaagtccgcattggaaaccggatttatgacggaagcgtgagcggaaagcttgagcgcatggaacgtcaacttgccggaggaaatcgatagaaggggtgaaacctaagtgagcatcaaagctgaagagattagcacgctgataaagcagcaaattcaaaattaccaatctgaaattgaagttcatgacgtaggtacagtcatccaagtcggagacggtattgcgcgtgtgcacggccttgacaattgtatggccggtgaacttgttgagttttcaaacggcgttttgggtatggctcaaaaccttgaagaatccaacgtaggtatcgttatcttaggaccttacagagatatccgtgaaggtgatgaggtcaaaagaacaggccgtatcatggaagttcctgtaggtgaagaattaatcggacgtatcgtcaacccgctcggacagccggtagacggactgggtccgattctgacaagcaaaacacgtccgatcgaaagcccggctccaggcgtaatggaccgtaaatcagtacatgagccgctgcaaacgggtatcaaagcgatcgacgcgttaattccgatcggccgcggacagcgtgagctgattatcggggaccgtcagacaggtaaaacatctgttgcgattgatacaatcttaaaccaaaaagatcaagacatgatctgtgtgtacgtagcgatcggccaaaaagaatctacagtgcgcggcgtagtggaaacacttcgtaagcatggcgcgcttgattacacgattgtcgtgacagcgtccgcttcacagccggctccgcttctgtaccttgcaccgtatgcaggggtgacaatgggtgaagaattcatgtacaacggcaagcacgttctcgtcgtatatgatgatttatctaaacaagcggccgcttaccgtgagctgtcattgcttcttcgccgtccgccgggccgtgaagcattccctggggatgtattctatcttcactcccgtctgcttgagcgcgcagccaaactgagtgacgcaaaaggcgcaggatcaattacggcgctgccgttcgtcgaaacacaagcaggagatatctccgcttatatcccgacaaacgtcatttccattactgacggacagattttccttcaatccgacctattcttctcaggcgtgcgtcctgcgatcaatgccggattatccgtatcccgtgtcggcggatcagcccaaatcaaagcgatgaaaaaggtagcgggaacattgcgtcttgacctggcttcataccgtgaacttgaagcgttcgcccaattcggatctgatcttgaccaggcgactcaggcgaaactgaaccgcggtgcgcgtacagttgaagtgctgaagcaagacttgaataaaccgcttccggttgaaaaacaggtagccattctttatgcgctgacaaaaggatatcttgatgatattccggttgcggatatcagacgttttgaagaagagtactacatgtaccttgatcaaaaccataaagatctgcttgacggcattgcgaaaacaggaaaccttcctgctgatgaagacttcaaagctgcaatcgaaggcttcaaacgcacatttgcaccaagcaactaacccttagaagatgagagaaaaaggttctctttttctctctttttacgcaaatgaagaataaaggtggtgaaatctttggcctcattacgcgatattaagtcaaggatcacgtcaacgaaaaaaacaagccagattacaaaagccatgcagatggtatccgctgcgaagctgaaccgtgcggaaaccaacgcgaagtcatttgctccgtatatggataagatccaggaggttgtgtttaacgtcggaaaaggcgcgaaaaacgcgaaacacccgatgcttgtctcaagagaagtgaaaaagacggcgtatctcgtcattacgtctgaccgcgggcttgcgggtgcgtttaacagttcggttttgcgaaacgcttaccgcaccattcaagaacgccatcagtctaaagatgaatacacggtgattgcaatcggcagagtcggccgcgatttcttcaaaaaacgagaaatgccgattttgtctgagttagtggggcttggcgacgaggtcacttttgctcagattaaagatttgacccgtcagacggttcaaatgtttatcgacggcgcttttgatgaactgcatttggtgtataaccatttcgtcagtgcgatttcacaggaagtgacggagaaaaaagtgctgcctttaacggatttcggaacgagcggcgggaagcgcacggcttcttacgagttcgaaccggatgaagaagaggtgctcgaagtgctgcttcctcaatatgcggaaagcttaatttacggcgcgcttcttgacagtaaagcaagtgaacacgctgcgagaatgacagcaatgaaaaatgcgacggataatgcgaaagaactcattgattcactttcgctttcatataaccgcgcgcgtcaagcagcgattacacaagaaattaccgaaattgtcggcggtgcagccgctttagaatagaaagattttgtcaggagggatagcgatgaagaaaggacgcgtaagtcaggtgcttggaccggttgtcgacgtacgtttcgaggacggccacttgcctgcgatttataatgcgattaaagtttcacagccagctacaggcgaaaatgaagtaggcatcgacctaacgctagaggttgctcttcatttaggtgacgatacagtccgtacaattgccatggcatctacggacggaattcagcgcggaatggaagctgttgatacaggtgcgccgatttctgttcctgtcggtgatgtgactctcggacgcgtatttaacgtactgggagataaaattgatttaaatgaaccgctgcctgcggatgctcaaaaggacccgatccacagatcagctccttcattcgatgagctttcaactgaggttgaaattcttgaaacgggaattaaggttgttgacctgctcgctccttacatcaagggcggtaaaatcggattgttcggcggcgccggcgtaggtaaaaccgtattaatccaggaattaatcaacaacatcgcgcaagagcacggcggtatttccgtattcgccggtgtaggagagcgtactcgtgaagggaacgaccttttctacgaaatgagcgattcaggcgttatcaagaaaacagccatggtcttcggacaaatgaacgagccgccgggcgcacgtatgcgtgtagcactgacgggtcttacaatggctgagcatttccgtgataaacaaggacaggacgtactgttctttatcgataacattttccgtttcacacaagcgggttcagaggtttccgcgcttctcggccgtatgccttctgcggttggttatcagccgacgcttgcgacagaaatgggtcagcttcaagagcgtattacgtctacaaacgttggttcagttacatctatccaggcgatctacgtgcctgccgatgactacactgacccggctccggcgacaacgttcgctcacttggatgcaacgactaaccttgagcgtaaattaactgaaatgggtatctaccctgcggttgatccgctggcttccacttcccgcgcgcttgctccggaaattgtcggagaagagcattatgcggtggcgcgtgaagtccagtcaacgcttcagcgttacaaagaacttcaggatattatcgcgattctcggtatggacgaattaggtgaagaagacaagcttgtcgttcaccgcgcccgccgtatccagttcttcctttctcaaaacttccacgtagctgagcagtttacgggacaaaagggttcttacgtgcctgttaaagaaacggtacgaggctttaaagaaatcctttccggtaaatatgaccatcttccggaagatgcattccgtcttgtgggacgcattgaagaagtcattgagaatgcgaaagagatgggtgtagaagtttaatctggtcctaggagggtaaaagcatgaagaccgttaaagtcaatatcgttactcccgacggcccagtatatgatgctgatattgaaatggtaagtgtaagagccgagagcggtgatctcggtatcttgcctggccatattccgaccgtggctccgcttaaaatcggcgctgtccgccttaaaaaagacgggcagaccgaattggcggctgtcagcggcggatttttagaagtccgtcctgatcaggtcactatccttgcacaagccgctgaaacagcggaaagcattgataaagagcgcgcccttgctgcgaaaaagcgggcggaagaccgtttgaacaaacgatcagatgatactgacattcgtcgggctgagcttgcgttacagcgggctgtaaacagattggatgttgcaggaaactaaaaaagaatccttctcggctgtctgagaaggattctttttctatattaacgcataagagattcatagacgccgataagcggatgatcctcttctttttgcagatataaatgttcgcagcagttgtcggtgtgccacgttttgtttcctctccgcacacccgtcgtataagcgccgtccgtatacggataaggtttgacgacccattcggcatcgtcatggtgtctgatggcgcaatcgatgacatacacgctgagcattttctcaaattcgtcaatcggcaggttccaatccgccaaaagcagctcttttatgctgcggaagtaaagagcttccacttccagcaggctgccgcgtgaataatcaagagaaatattgaaaaactgacataattctttcagttcctctgtttgagactgtctataatcatagtagaatgctatcgcttcccactcgtggtcaaatacgggaagagtttctccatactgcttttccggatgaaaaaaggaatgattcatattcccatctcctttccaaaaaagtatatcatgccggagaacggacatttaagcggggattgcccctaattttggataaaaattctgatgtaaaaatgatcatctttctctcttcttcttatataataagagaggatatgaggggcggaaaaaatgaaaggagatgggatttgtgaatgtattggggcagcaggccgcaatcagcatcctggttcacctggtatgcattgcggtgacatggtgggcgcttcaggccgtcaactttgatccgctgatccgaaaaggaaaaatagtgcaggcgaggctgctgatcattcttcttaccattgcgatcggtacggcagtcgctgacttctttttagattatcttacctattcgaaacagcttccatacttattttaagatgtttcgtttgttaaaatgaagggaatcgctgggtgagaaaccaatttttcttcacccgcttggcgagttttgacgaagttttccatgtattgctttccccggctccggcaaaaatgggagtaagggggagagatcgatatgaagaaaaaaagagcaggccgcatcatcttattttttgtttttttaagcgccttaatagcggtatttcattccattcatgcaagtgagctgtctccgcttgcccagattgccgaaggaatggagcggcagcaggtcactgtagatgaatggacgcttcatgcgaaagaaaatctgaacctgtcactgagtgaatttgatgacaaggtaaaagaactgaagacacagtatccgcaatatcattgggaatctgcgcgggaagataaaatcgtaaaggccgtcggcacgtattctgacaaaaaaaatcacacaacttttaaactgcagctcgtcactcccctcaaaaaccagaacccaacttcgtatttattatatgagcaaatgagcccggagcaaccggaaaactggaatgatacatatgaacagtttgaacggcaggcacatgacatatttcaaaataaagtatttatttttacttgtctaaagggtcatttaaatgataatatgagtattgttttgcaaaaaaaagcagaacagctcatgaaagaatttgaagcaagtccagttgaacatgtagttgagcctcatttcgtttctgtttctgcatttacatataagtggacagattacatcatgacatcgaaacataagatgaatgtgcaagttgcgcttagaagtgcgggaatgggcgaaaaacataccgttacggttggcacaccaatcgtgacgactgaatattaatatagagaatatagggacgcggaggggaataccttggaaaaaatcatcgtccgcggcggtcagaagttaaacggcacagtgaaagttgaaggagcaaaaaatgccgttttaccagttatcgctgcatctttattagcaagtgaagaaaaaagcgtaatatgtgatgtacctacgctctccgatgtatatacaatcaacgaagtgttgcgtcatttaggagcagatgtgcattttgagaataatgaagttaccgtaaacgcttcttacgctttagaaacagaagcaccttttgaatatgtgcgtaaaatgcgcgcgtcagtgcttgttatgggccctctgttagcccgtacgggtcattcaagagtagcgcttccgggcggctgcgcaatcggctcaagaccgattgatcagcatttaaaaggctttgaagcaatgggtgcaaaaatcaaagtaggcaacggctttattgaagcagaagtggaaggccgtctgcagggcgcaaaaatctatttagatttcccaagtgtgggtgcgacagaaaacttgattatggcagctgctttagctgaaggaacaacaacgcttgaaaacgtggcaaaagagcctgaaatcgttgacttagcgaactatatcaatgcgatgggcggaaaaatccgcggagccggcacaggcaccattaaaattgaaggtgtcgagaagcttcacggcgtaagacacaacatcattcctgaccgtattgaagcgggtactttcatggtggctgcggctatcacggaaggaaatgtattagtcaaaggtgcggttcctgagcatcttacgtctttaattgcgaagatggaagaaatgggagtcaaaattacggatgaaggagaaggccttcgtgtcatcggtcctgcccagctgaagccgatcgacattaaaacgatgcctcacccaggattcccgactgatatgcagtcgcaaatgatggcgctgcttctccgtgcgagcggaacaagcatgattactgaaactgtgtttgaaaaccgttttatgcatgctgaagaattccgccggatgaatggcgacattaaaattgaaggacgttctgtgatcattaacggtcctgtacagctgcaaggcgcagaagttgccgctacggacctgcgtgcgggcgcggcgctgattcttgcgggattagtggctgaaggtcatacacgggtcacggaactgaagcacttggatcgcggttatgtgaatttccatcaaaaacttgcggctctcggcgctgacatcgagcgtgtcgttgatgaaacggccgctgaacaagaaagcaaagaagtcgtaactgacctaaacgcataatggctgtaaaaacagtatgtcaatctggcatactgtttttttatggtttatcatcattattatgctctgatttccaaaaaagaatacgtttttcgcgtgaaaaatggaataaagattctgtccaaaaggaagtcatattagcttgtccctgcccataagatgaagtagagtcgaatcccaagcaggaggcagctgatatatgaaaccgattgtatttctactatccgggctgtgtatacttattcttctagtccccaccattctcgtccttccgtttcaggcagaaaaaggcgcagccgtaaacagagagcccggacacaaaacagcacacaccacacgagaaacaaaaggagcagaaacattgaaagaatcacctgtatccattccggtttatcggacatccaatcattctgtagaaaacattccgcttgaagagtacgtggtcggtgtcgtggcttccgaaatgcccgcaaactttaaaccggaggccttaaaagcccaggcgctcgccgcccggacattcatcgtcagactgatggtcgctgactcagccgttcaggcgccgaaaggatcactggtggatgatacgcaaatgttccaagtctatcaaagcaaaagccagctgaaaaaagaatggggttctaagtacgcacacaacctcaagaaaatcacaaacgcggtcgccggcacgcaaggaaagattttaacgtacgacaacaagccgattgaggcatctttcttctctacgagcaacgggtatacggaaaatgcggaagcctattggacaagcgccattccttatttaaagagcgtgaaaagtccgtgggataaacaatcgccgaaatatctcgccacccagaccttcagtgtgccggagtttcagcaaaagctcggcgtacagctctcgggacaaaacacggtgggacagattacagccagaacgccgggccatcaagtggcgacggccgtcataaacggtaaaaagctgaaaggaagagacatccgggaaaaactcggactccgttctgccgactttgaatggaaacggaacggcggcagcatcaccattacgacaaaaggattcggccacggcgtcggcatgagccagtacggggccaattacatggcgcagcaggggaaatccgtggcggacatcgtcaagcattattatcagggagtggacatttccgaagcagattcatttttaaacaaatatatggcgaaaaaatagacgctttcatgagcgtctgttttttttgaaaactattccataaacggtaaagcaaccaacagactcatataacgaaagcctaaaggctgacaaatgccgattgaaggctgagcgccgggtgtaaatcactgataaaaatgccgcttctatgtgaatatgcgcaaaaataatgaggaacgccgtcctatttatttcccttttcatctcatttacgataaatattgttcggcgttgaacgtaaatctattgaaaaggggaaaaagcaatgaaaaaaacattttcactcatactcatgctcggattgatgctgactgctgcatctcctgcttttgctgccgagaatgcaaacgagaagactctttcatttaaaaacaataccgccattttacttgatgcgagcggcagtatggcaaaacggattgacggtgtttctaaatacaacatggcaaaagaagaaattgtccgttttgcggatcaaattaaatctaaatcacaggtcagaatgacggttttcggttcggaaggcaataataaaaactccggaaaggttcaatcttgtgaatccattcgcggtgtgtacggattccaaaggtttgacagacagagcttccttaactctcttaacggaatcgggcctacgggctggacaccgattgcaaaagcattagaggatgcgaaggcttcctttaccggtttgcacaaacttggcagtaaatccgttttcctgttgacggacggcgaggagacatgcggaggagatcctgttaagacagcgaaagaacttcgcaaacagcatattaaagtcaacgtgatcggctttgactttaaggaaggcttcaacggccagcttcacgagattgccaaagcgggcggaggaaaatattacgaagctcacagccaaaaggatatgaaccgcatctttacaatggcagcgagttcattagcggaataagaaaaggtgccgtttatcggcccttttttttatttttatttaacaaaaatttcaagaaaagatgaagagaaaactgtaaaaagaatcagattccggacttatattacaaaaagggcgaaaaaggcattaaatctgtcatcatttatgcaatctttttaggatgatgcgcataattctgttcatttttaacggcgtacagccgcttatacaaaaggaatcccgccctatatctttttgcatactcgtcatctagcatagagaagagccgggggcccatcggccaaaaacaaacggagaggaatgaaggaaatgaaaaaaatgttcactgcggggattgtcggacttttgacgctttcactcggatcacctgtttttgcagctgagaaaaagcacgaagaaacaaacgttgccgtgctgtttgacgcaagcggaagcatgatacaaaaaacagggggagagcgtaaaatagatgttgcgaaagagtctgtcacttcttttgcggaagttcttcctgaagacacgaatctgatgcttcgggtattcgggcataagggcaataataaaaactcaggcaaagccgtatcatgtaatgcgacagaaacgttatacggccttcagccgtacgccgtgactccatttgagcaatcactcagcaagattaaaccgaccggctggacaccgattgcgaaagcgctttctgatacgcgtgaagaatttgagcgggccggcgccacagggaaaaacgtcgtatatctgatcacagacggtgaagaaacatgcggcggtaatcctcaggccgaaattcaaaagctccgtaaagcgaacgtcaacacgatcgtcaatatcatcggcttcaacttcggcatgaaaggaagcgaaagccttgaaaaagcggcggaagcgggaggcggcacatatgtctcagctgacagcgcggacgagttcaaacaggcttgggaagacgctgcaaaggatttagcaaaagaataggttaaaaaaggacgcccgcgcggcgtcttttttgtttagaaaacaaaaaccgcgggaatgatacggataaaaggagatgaacgctgttgttaaaaggagcaggcattatattagtgctggcggcagtcgtttttgttctgatgggaatttttctgaagcttgccgccttcatattcgtcagtatattggccattatcgccgcagttattttattcaccattctgagcagacatcatcgcaatgaaacttagagtcctaagagggctctttttttaaaccgcaaattcgacaaaatacagggattgtggaagaataaaagagaaggatactgcggaggggaaaacagtggatgaaaaaacaacagcggtaagagacatataccgctatgaaaaaggggtattaacaaagacggcagatcggatggtttcagagtatccgctgaccgtcatggtgaacgggcaggaatttgttacgctcgtctgcacgcctgaccatttagaggaactcgtcatcggatttctcgcatcagaaggcgtcattcgttttgaaaaagaaatcaaaagctttactatagatgaaagtctcgggtttgcatatgttgaactgacgaatcccggagtgcttgagcaaaaagactatacgaagagggtcatcggttcatgctgcgggaaaggccgccatttttactttcagcaggatgtgaaaacggccaaaaccgccgtcagccgtatcactataactcctgagacgtgccttcgcctgatgaaggagatgcaaagcgggagcggcacctttcaggaaacgggcggcgtccataatgcggcgctgtgcgatacggaaaagctgctctttatgaggacggatatcgggcgccacaacgcgctggataagctgtacggctgctgtttgaaaaacggaatgccggtccgtgacaagctgatcgtcttcagcggccggatttcctcggaggttttattaaaagccgcaaaaatcggcgtgtcgattgtcatttcaaaatcggcgccgacggagctcgcgctgcaaatggcggaagagctgaacataaccgcgataggttttgtcagaaacggatcatttaacgtatacacacatcctgaacgggttgaacaatagaaaggggtcttgggcttatgaatacagaaacgcgccgggtgacagacaaaagggaaaggccgctcagggatcttcgtatctctgtaaccgaccgctgcaacttcagatgcacgtactgtatgccagccgaattattcggaccggattatccatttttacaaaagacggaattgctctccttcgaggagcttgagcggcttgcgaagctgtttgtcggccgcttcggcgttgaaaaaatcaggctgacgggcggagagccgctcatgagaaaagatatgcctgaattgatcaaaaaacttgcgcgcatccccggacttaaagatatcgcgatgacgacaaacggctctctgcttcccgtgtatgcggaaaaactgaagcaggcggggctgcatcgcgtgacagtcagcctcgattctttagaggatgagcggtttaaggccattaacggccgcggggtttcggtgaacaaggtgcttgagggcattgaggcggcaaaagcggccggactcggtgtgaaaatcaatatggttgttcaaaagggcgtcaatgaaaaagatatcctgccgatggcccgctattttaaagaaaagggtcatattctccggtttattgaatttatggatgtaggcaatacgaatcaatggaataaaaaagacgtgatcacgaaggcagagattattgatctgatcaaccagcacatgccgacggagccgatagaagcgaattataaaggagaggtcgcttccaggttccgctatcttgacggttccggcgaaatcggcgtgatttcctccgtctcggatgcattctgcgcctcctgcaacagagcgcgcctgtcggcgagaggcgagctgtttacgtgcctgtttgcgtcaagcggctatgatgttcggaaactcgtgcgcggcggtctgaccgatgatgaattgacggaatccatcgcttctgtctggagaaatcgcacggatcagtattcaattgaccgcgcgctttctaaaacggatgggaaaaagaaagtggaaatgtcttatataggcggatgaagaaaagcttgcccggacaagggcaggcttttttattcacaatatgagagcggtctgttcaaaaaataccggtgacagccgaaatatatgataggaattttgatgcaggacaatcaagttatgcaattccaaagccatacaatatgttaaaatataaccaatagaaattagaaaaggttgtgaaaggggcatgaccgcatacgagattccgtcatctcaagttggagtcaagatcaacaaatggtacaagcacattttagcgtttcaagcggctgatgccataaagctgaaagaggaaattgatgaggatatacaacgtatggaggaagaccagctgctgctgttatattatcagctgatcagctaccgccatcatattatgcttgattacgtcaagccggaatgcaccgaacaatcacagattcagtacagcgagctgcaaaagacgatcgaaagcacggacagcatatcgggactgtctgagtattatttccatttgttcagagggatgtatgaattcgatcacaataactatgttgcggctatttctttttaccggaaagcggaaaaactcctttcatttgtcgaggatgatatagagagggcggaattccatttcaagatgtctgaagtgttttatgtcatgaagcagactcatttttccatgaatcacgggattcaggcgctggatacgtatatgaaacacgatttctacagagtgcggagaattcaatgccatttcgtcatctcaggaaactacatcgactgcaaaaactacgacaaagcgcttgagcatttagacgaagccctccgcctttctttgcttgaaggacagccccgcctgatcgggtcttcgctttacaatctggggaattgttattctgaaaagcgagatctggatgaagcggcccggtactttagaaaagcggttcccgtttttgaagagcatcagcttgaacagcttccgaaggcgctgttcagcttaacgcacacccttttcaggctgcatgatgaccaagcggcccttacctattatgaaagaggggtcatgatcgcgaaagaacggggcgatcgattcagtttagagaagtataagtttttacaagcgctttatttggagtcactcaatatggatttaatccatgaagtgtttgactatatgaatgaaaaatcgctgtatgtgtatattgaagatttcgccttggaggccgccgtttacacaagcgcacatgagcaatataaagaagcggcgtatttttatgaaaaagcgattcgcatgagagaaaacattcaaaaagaacagtgtttatacgatatataattttcttaaccatctgatcagcagatggttatttttttatgcacattataacgtttgatcatagaaaaaaacggaaaaatcgcaaaagagagaaaaaagcatatgcgagggggggatttgttgttcggattcaatgatatgataaagtttttcgtttcttttctcatcattctgccgatggtgtctgtcatccatgtgtcggggcacagctttatggccatgctgttcggaggcaaggcgtcattggatatcggaatggggaaacgtcttctaaaagtagggccgattcaggttcggcgtatctacttcatagattctttctgcaagttcggcgaattgcggatagataaccgcctgacgagcgcgctcgtctattccggaggctgtctgtttaatctcgcttctatctttttaataaatctgctgatcataaaagatgtcctcgagccaaacttatttttttaccaatttgtctatttttcaacttattatgttttctttgctcttctgccggtgcaatacggggataataagctgtcagacggattggctgtttacaaagtgctccgctacggggaacgctgtgaaatcaataattgagagtttacatgtttgtgttcgggctgaaagggaagaaaacaagtacacagaacaaaaaaggagctgaagagatcatgagtgaagataacggtttaaaagacaaagtaaaaggcggcatgaacaaaatgaaaggggaagcaaaggacaaagcaggcgacatggcaaacaagtccgacttaaaagcggaaggtaaaaaagacaaagcgaaaggcagcctgcaaaagggtgtcggcaaaacgaaagataaactcagtgatgattaatttgatagtgaaacacagcaaaagcccaaaatattttgggctttttgttatgagaaatgacaaaaattccagttcatttggttaatattcactaaattttgaaatattctataaattccccggcaatttctttataatattcacatagaatgtaacctttcttcacatttgattaaacgtttgttgaagaaaaaaatgagaaatcggtaatttctgcaaaaggaatcgggccgttcaccgtcgaataacttttatcacttaacatttcatgaggtgaagggggtgacggccgcctgcatcgtttcggtatgacatgcggattgtgtttgactatcactaagggggaatacagatgaaactgacaccggttgaacaagaaaaattgcttatttttacggcgggagagctcgctaagcagcggaaggcgcgcggcgttctgctgaattatcccgaagccgccgcatatttgacctgttatctgatggaaggcgcgagagacggaaaaagcgttgctgagctgatggaatccggccgcaatgtattgacggaaaaagacgttatggaaggcgttccggaaatgctggacagcattcaggtggaagcgacgttcccggacggggttaagcttgtcaccgttcatcagccgatcaaagcggaggtgaagtcatgaagccgggagcgattcaagtcgcaaaggggaccatcaccattaatgaaggccggaagacgctggaggtgtcagtcaccaataacggaacacggtcagtgcagataggatcgcattttcattttgccgaagccaacggcgccctttccttcaatcgggacaaagcaatcggcatgcgccttgatatcccgtcaggcacatctgtccgttttgaaccgggagaagagaaaaccgtcacgctcgtggaaatcggagggcgaaaaacggtcagaggtctgaacggcatggccgatacgtatatggatgagcggggaaaagagaagactctgtcaaatcttaaaaaagccggatggatggaggaggcgatccgatgaaaatgtcacgtgagcaatacgcagaactgttcggaccgacaacgggagacaaagtcagactcggagatacggatttatggattgaagtcgaaaaagatttcacgaattacggtgaagaaatgattttcggcggagggaaaacaatccgggacggcatggggcagaacgggcgtatcaccgggaaagacggagcgcttgatctggtcattacaaacgccgttatcctggattataccggaatcgtcaaggcggatatcggggtgaaggacggccggattgtcggcgtcggaaaaagcggcaatcctgatatcatggatggggtggacccgtacatgattatcggtgccggaacagaagtcatttccggcgaagggaaaatcgtaacggccggcggggtggatacgcatatccactttatctgcccgcagcagatggaagtcgcgctttcttcaggcgtgaccacgcttctcggcggcggaacgggtcctgcgacgggaagtaaagcgacgacttgtacatccggtgcatggtacatgtcgagaatgctggaagcggccgaggagtttccgatcaacgtcggtttcttaggaaaagggaatgcatccgataaagcgccgctgatcgagcaggtggaagcaggcgcgatcggcctgaagctgcatgaagattggggatcaacgccaagcgccattaaagcttgcatggaagcagcggatgaggcggacattcaggtggcgatccatacagacacgataaatgaagcgggctttttagaaaatacgcttgatgcgatcggcgaccgggttatccatacatatcacatagagggagccggcggaggccacgcaccggatattatgaaactcgcatcttacgccaatatcctgccgtcctctacgacgccgacgattccgtataccgtcaacacaatggacgagcatcttgatatgatgatggtctgccatcatttagattcaaaagtgcctgaagacgtggcgttcagtcattcacgcatcagagcggccaccattgcggcggaggatattctgcacgatatcggcgcgatcagcatgacgtcatctgactcgcaggcgatgggcagggtgggagaagtgattatccggacatggcaggttgccgataaaatgaaaaagcagcgcggcgctctatcaggagaaaacggcaatgacaatgtgcgcgccaaacgctatatcgccaaatacacgatcaacccggccgtcactcacggcctgagccatgaagtcggttccgttgaaaaagggaagctcgccgacctcgtactatgggacccggttttcttcggcgtcaaacctgaacttgtgctcaaaggcggcatgatcgcccgcgcccagatgggagatccgaatgcttccattccgacgcctaagcccgtgtttatgcggcagatgtacgcatcatacggtaaagcaaaccgaaatacctctattacatttatgtcccaggccggtatcgcaaacggtgtgccggaaaagctcggccttgaaaaaatgatttctcccgtacggaatatccgtaagctgagtaagctcgacatgaagctgaatgacgcgatgccgaatatacaagtcgatccgaaaacctatcaggtgttcgccgacggagaagagctggcatgccagcctgtcagctatgttccgctcggacagcgttatttcttattttaatccctctccggccggtttcccgccggcctgtttacacctctattgccaacttgatttcatcctgccgcccgttttagtgtatattagtagttgacaaacaaatgaaatgtaactattacggttacaacggtggtgaaaaacatgattaacagccgtcttgctgtggccattcacattctatcgctgatctcaacggatgaacgggcgtcatcggacatgattgcgggcagcgtaaacaccaatcccgtcgtcgtgcggagaacgatcagccagctgaaaaaagcgggtattctgacatcccgggcgggtgttccgggagccagcctgaaaaaagatccgtcggagatcaccctcttagaggtttacagggctgtgcagaataaggaagagctttttgcggttcacgacaatccgaaccccgactgtccggtcggcaaaaatatgcagcgtgcgcttgatgagacgttcggaagcgtacagcgggcaatggagaatgaacttgcgagcaagtccctttatgatgtaatgaatcatctcttttgttaaaaagagatggttcatcccgctatcggtgtaacaaaaatggttacaagaggtaatgaggaaatcacggtattggctccatattcagacaagcctggatgcgggattgcgatctgtttaatgaaaaaatcctccgaaactaaaggaggcggttaccgggatatttttattttgcttaaggcttatgtgaaggtgtcagctgtgagcaagttaaacaaaaaatgatatcctgcttccagcaatgccaaaaccgttcgcctcttaataatcattataaaatgtctcaaggaacgatcagcagcccgttagctgcccctaattaaagatgagctgttaccacactgttacattagaacttccgctgcttttatatccttctgtcgctaagacttgataagcccaattactgcccagattcattccatggctcttccatgcgttaacatgattgctgaaagtgattgcagcgttgcttcctgtcggtctcttcgactggcggacactccagtactgcgtaaaagtagtgttatcgccatcaatggaaggtgcattataacgtgtcgttgtatatatgtcatatgtacctccatcactctttacagtacctttatacgttccggtaggtctgtaagtaccccatgaatccaccacataatattcgatgagaggtgctctcgtccagccatataaagtcaaatatccattgccattcggcgcccaaacaccggcattatagtttattgttctaaatggcgagcctgtagtccagcctttaccaacaacgaaattcccggtattagaccaattaacactgtaattcccgccagagccattgactgcgtttactgttccgcccccgtcagtccaattttgccagtaatctgtgccagctgcagaggcggttgccgaaaacatgctgatactcatgaaagctgccgttaatcccactaagaatttctttttaaacttaaacatatgttacctcctatactattttttctgactttgacatgaggcagcactcgtaaatatttaacaaacgccaacgcttttgatcgttcctttcaatataatagcatgaatacatgagtgaatattaagaacaattgttatttaattacaaagacccaaaaaactgtatgatgagtggtcttgtaccgccatagccttatttcgcagaactgagtgatttcagttgaaactctgaggaaaagttttatttgaaaaaacttttttgccgaaagaatatctgcatacagcgcttcagcaggcgagaatttacaagaccttgagagcacggagtccatgacccgaacggaaagcgcgctggagcatacagcgtcaatgctgttcgccgtattggcaaatccaaagcagaaaaactttaccgttaccgaagaagcggaataagaaaaaatcccgggcggatgcgccgggattttctttttaatatgtattggcatcaatattattaaacgcgtcgtccacgatgccgagcgtcatgaggacaatgaagagaacgataccgagaacggacaagccgaccgtcacaatcaggtagatcccctgcattttcacgaactttgcataattctccagcatatgttcctctgtcagttcattgaactgctccgccatctgtcccgcttcatttgccgagcgcatcagaaaaatgccggcaatgatctgcaaaacgccgggaatggctccgattaaaaagaaaaacgcgcccgaaagcgccgcaaacgcgcctataataataaataaaatacctgtcgcttttccccacttcgaaatagaaataagcgaacgattcactgattcaggtttcaaactatggcactcctttacaaaaaaatactcacttttcatttatacactattcggtcattcttttgaatataaaatgtgttttttcatgccgtgtccgtttttgtatcagaaaattcccgagaaacaccccgggaattacaaaatcggcgaaagaagtcttgaaatcgattctttaatgcggatctgcagcgaacgctcctgatattcttcatacgtatattttctggagacgagcagatcttctttaaatgaggaaatgagttttttcgcgatggtgacgtcataaataaaggcgttgacttcaaaattaagtctgaagcttctgacgtcgatattcgccgtaccgacggaagccgtctcatcatcaacgacaatcgtttttgcatgaataaagccgttatcgtaaatgtagactgaggctccggctttcaaaagatcgccgatgtaagataaagtcgcccagtaaacgaaagcgtgatccggcttgttcggaatcatgattttgacgtcgatgcctgacagacaggcgatcctgagggcatctaaaagacttgagtcaggaataaagtaaggcgtctgaatcaggatcgaccgtttggccgttgagatcatcttgatatagccgtttttaatttgttcccattctgagtccggtccgctcgtgacaatctgcatcccgacattgcccttcggctcgcattccggaaaatgattcggaacgtatgtgagcgtatgatgatgggaggcttggttccaatcgaggataaaccgtgtctgaatggcgtgtaccgccgtgccttgaagcctgaggtgcgtatcgcgccagtagccgaatttcggattcaggccgagatattcatctccgacgttaaagccgccgacatagccggtttcgccgtcaatgatgacgagcttgcggtgattccgataattgagccgcaaattaatcggacgaagcctggaaggaaaaaagacttccacatggccgccggcgtcccgcagcggtttgaagaatttttttctgagtgatcttgaaccgagttcatcatataacactctgacctttacgccttcccgtgcttttttcactaaggcattgcgcaatttttttcccagttcatcacctttataaatatagtattgaaggtgaatgtgatcttttgcgttggaaatgtccttcattaagcgtttgaacttatcgcgcccgtccgttaaaatctccaccgaattatcctctgtaaagactgcgtggttgttcatgacaagcatatagatgaggtctttattatccacagtcgccctgttgttaaattggaattgcctcgacttcaggtctttcagctgagacttcagcagcttttctatcccgatttttttacggtcttcccattgaaacagatgcttgcgtctcaggttatggccgaataacaggtataaaataaaccctaaaatgggaataaaaaaaagaaccaagagccaagcccatgaagcgctggcatcgcgtctttctttgaaaatcatgatgacggccaaaagtatatttaaaacgaaaaaaaatccgaataaaataaatgaaatgctcactttgcaaccccgctatatcatatttatcaagactgtgcccattagtattccgacaagtgcagcaatctgattcccatttcaaattataacattgacattttgaaagaataaagagccggaatcaaagatgaatgcagttttctttcaaagaaagttccgggtgcggtaaaatatgcatatatgaaaaagaagacaaaaatgacagcaaaggggagagggcatgaagctggagcatgcggaacaattgccgggattcataaaaaaagaaattcagaaaatacaaatcgccatcgcgccgctgatgaaaaaaagcatcatttaccgttttcttgctttcccgctcgccgcttttagtctgtttcatctggcatcgcttttaattcaggccccttccgggagaggagctctcgtatcggccggcatttttgccctccttgcggctctgggtcttgcgttttttaaggaagccggctatcagcggaaacaggtgcaaaaaacgatccgcctttatatgctgaacaggatcagaaaaagcgatattctgtctgaggaacggaaaagcgcctatacccggctgattgccgaggagccgtctgcgatgaagagctttattgaatttttaacggaagaagaccggaaaaaagaaatgctttattaaaaaagagctgacgcgcgatcagctctttttgtcattcaaacacagggtcgttctcatagtaatatgaatcaggcgtgtcatacgtatcagtgctgtaataagccataattccgatgacagcgaagatgacgactaaaataaaagcgagaatgcccagtaccacactggatgccgcgtaaaaaaactgcattttgataaatgacgcgtaatgtgcaagcatattttcttccgcgttttcttctagtccttcctgaagggcggcagccgcttttgccgagcgcatcagcatgacgccggaaatgatgagcagaacacctggaatggctccgagcagcgtcacaatggctgacagagcggaaagagagcccgtgatgatcagaaacacggcggtgatctttccccatttggcgatgtcggcaagggaacgggcttttttattgagcggctggttttcgtctttgtctttatcgatggtgatcatgacagttctctccctaaaatgttcaagtcatatcgttttccgtccatttcggcgatacccgggaatacgccccattcggtaaaaccgaatttttcaaacagcttaatgctcggcacattatgtccgaagataaaagccatcaggctgcggatgccgattgccggagcgagtgccagggcttctttcagcagaaagcttcctgctcctttgccgcggcaatcctgatgcagatagatgctgatctccgccgttttgtcataggccggacggccgtaaaacgtttcaaagctgatccaggccgccactttgccggtttcatcttccgcgaccatcagcgggcgccggtccgtgtgccgcagaaaccaatccatccggtctgcgggcgttacttcttccgtatcagccgttaccattcgtgaggcaatcgtcgagttgtaaatggccaccaccgcatctaaatcctccaatacggctttgcgcagggtcaaattcatattccgggatctcccttcacatttcattacataaataagtgcaatctgcacatactatttccaaaaaagttttttatggatgtgtatatattttcagaaaagtgttcagaatgttgctgaggtgatgaacaaatgagagaggaagaaaagaaaacttctcaagtcaaaaaacttcagcggttttttcgcaaacgctggatattccctgcaatctacttagtcagtgcggccgtcattttaacagctgtcctttggtatcaatccgtttcgaatgatgtgaaggacaatctgacgaacaacggcggaaactccgcgtatgacagcggcaaagacgatgccgtcgaagtaggcaagtcaatggaaaacgtcgcaatgccggctgctcattctgaaaatgtttctgttgtgaaaaagttttacgaatctgatgccgcaaaaaaagagaaagaagcagcacttgttaactataataacacgtacagcctcagtaaaggaattgacttagctgagaaagacggaaaatcatttgatgtttctgcttctctgagcggtacggttgttaaagctgctaaagaccctgtactggggtatgtggttgaaattgaacactcagacggcctgtctactgtctatcagtctttatctgaagtcagcgtggaccagggcgacaaagtaaagcagaaccaggtcatcggtaaatccggaaaaaatctttacagtgaagaaagcggaaatcacgtgcactttgaaatccgcaaggacggcgtagcgatgaacccgctcaattttatggacaagccggtaacatcaattgaaaaagcggcggctgaagagaaaaacgctgtaacagaagaaacggaagggtcaattcagcagtcttccgagaaaaaagatgtgacgcctaaaaaagaaaccgaagaaaaaccaggtgacaaagaagacggcacaaaagacaagacagatggtaaagatgacggctcaatgaaagattcgggcaagtaatcttgatcccaaagcgtctatcagctctgataggcgcttttcatattgccgcatgtgcctttatactagtagaaaacgaaggagatgctgaatgaataaatgtctggcggccgggtggctcgtctttgttttcgtttctgctttgactgaaagctttcacgatatgattgtgtcgcagacggtgtccttccgtttcacgtcccatccggatgtgtccggtttctttgtgttcaatatggcggagctcgccataccggaagcggcgattcaaaagcttgggcacgcgttttcattttttgtgctcgcctatttgtttttcagggagcgcaggcgcatgaagagggcggtgctgtatgcattggccgccgctttcctgacagaaatcgtccagctctttttcggcagaaacggatgcctccgcgatgtgctgattgacagtctcggcattgccgcattctgtgctttacaaaggaaaaagcatacagccaaacatacaaaaaccggcagtctgtgacagacgccggctttttttatatattatggtttgtcgatttgtttttatgaacgatactttcatagattcgcacgatcagatcgacaatcggacgaagcacatttgaaaatctgaacagcaggaatccgacaatgagggaaacgataatgcttccgagcacatcgatcggatagtggtggccgacccaaattcttgagaagccggtcaaaaggccgaaaatcacaagcggccagccgagttttttgttgcggaacagaatcgcaattgaaatcgccaaagcgcctgtcgtatggtcactcggaaatgaagcatccgcggcatgagggatcagtgtatgaaccgtatgctcgacaaaggggcgcggctcgatatagatcttcgtgatgaggtagttgacgataagcgccgcaacacccgtgaagcccgcgtacagggcgttttgtctgccttttgtgcttccgaacagccacatggcaagcaggaaaagggcgtaggcgtaaatggcgtattccgttataaataccatgatagagtcgagaatggcgctatggtgcgacaaaccattgatcgctttaaacagttcgtaattcacaaatatcaccttttatctttattttatatgaacagtgtaatgcttttttctatgagacacaattggtattaaaaataatcataaaaaagtaaacagaatgaaacgtgactgtattactgtgcgtcaagtatgcgggaaaagaatagccgaaggagttttgtccgttgctgaaacgtttgaaaaatgccgatctgccgcttgtgtttgtcattatgctgctttgcggattcggcttgttaatggtgtacagcgccagtgatgtgatggggtctcagcggtacggagatccatcctatttcttccataaacaaagtacctctttactgatcggattatgcttatttctatttgccgcctgtctgccgtataagcggtatgcgcggcttgtaccgctgtttgtggtcggttcgctggtattgctgctgctcgtattgataccgggaatcgggctggagcggaatttttcccgcaggtggctgggagcgggcccggttgtcgtacagccgtctgaattggcgaagatcgcgatgattttgtatttcgcttcgatttatacgaaaaagcagccgtacattcatcaatttgtgaaaggggttctgccgcctttagtgattttggggaccgcttttctgctgacattggcggagcctgatttagggacggcttccttaatcctggcggcgtgcgggtcgattttattatgtgccggcttgaaaaagcgccatctgttcgtgctcggcgcgacggcggtgtccggggttgtttatctcgcattttccgcttcctatcgtgtgaagcgcctcgtttcctttaccaatccgtttggtgacacgaacggggacggctatcagctgattcaatcctattttgctatttccggaggcgggtttttcggaagagggcttggaaacagtgttgaaaaaatgaactatctgcctgaggcgcatactgatttcattatggccgtgatcagcgaagagctggggatattcggtgttctgatcgttttgggattatattttgcgttaatgcttctcggcgtaaaaacggccgtgcgggctgatgacccgttcgggaagcttcttgccatcggaattacgtttcaattaatgtttcaggttgtattgaatttgggagcgatgagtggactcctcccggttaccggtgtgccgcttccgtttatcagctacggcggttcttcattgattatgacgctgtttttgtgcggcatactggtcaatatcagtacatatgcgaaaaaacaacccgtacggcataagcggcctgtcccgcatgaaaaaaaggtttcttctttttaatggagtccgaaaaaaaaaacgcccgggatatgctgtctccgggcgttctgtctgtttataaagcttctggtccttcttctccggtgcggatattaatcgtgtttccgatttcatagacgaatatttttccgtctccgggctctcccgttttcagcacttttttcgccgtttccaccacttgatcaacggggaccttgctgacaacgatttccactttcagccgttcatatacattgctttcaattttgactccgcggtatagttcggtgtgggctttttgaaggccgcagccgtgtacgttggagaaggtcagcgatgtgactccgattttaccgagttcctgttttaatgtttcaaacttagccggacgcgtaacgatttctaccttgaacatttgaccgctcatctaagccactcctcactttataagtcctgatatgctttttccccgtgcatcgttaaatcaagcccgagtgactcttcttcttcactggcgcgcaggggaatgaacagacctacaattttaatgataacgaaagtgacaataaatacaaatacataggtcgccgcaatggccgcaatctgcttccagagcagtcccggatcgccgtaaaacagcccgtttgccccgccgtcattgacggaagtggtggcgaataaaccggtcgcgatgccgccccatgtccccccgattccatgcaggccgaaagcgtcaagcgcatcatcataaccgaaagtctttttgagccaataaacgccccagaagcagacaagcccgccgatgaagccgattacgatggaagagaacggcgtaacgaacccggcagccggcgtaatggcgacaagcccggcaatagcgcctgatacagcgcccagcatggtcggttttttgttcagcatccattcgattaaaatccagccgataattccggccgcagccgcggtgtttgtgttaatgaaggcaaacatcgcgatactgtcaagcgtgagggcgctgccgacattgaagccgaaccatccgaaccaaatgagcgccccgcccaagaacgtgtaaattaagttgtgaggcgaagccgccgtgccgtccttgcgtttcccgagcacaatcgccagcacgagcccggcgaccccggaagaaatgtggacgacgtttccgcctgcgaagtcaagagcgcccatttggccgatccagccgccgccccatacccaatgcgcaacgggcgtatatacgagggaagcccacaaaaaggaaaatacaagaaaagcactgaatctcatgcgttcagcaaatgctccggaaataatggccgtcgtcagtacggcaaacgtcatttggaacatcatgaataatgaatgcgggatcgtatcactgtaacttccgggttcaaagccgacccccttcagcccggcccattcaatcccgccaagccatgtattcccgggggcaaaagcaagtgaatatccgtacaaaacccaaacgacggatacgatggcgagggaagaaaaactgtgcatcgccgtgctgagcacgtttttgctttttaccattccgccgtaaaacaaagccagcccgggggtcatcagccacacgagtaaagcgcaaaagaacataaatactgtatcgcccatctgcatgttgtattcctccgtctcattcaaaatgtaatcgtgattaattcattattatagagaaaaaagaacgataaaacattttcgtgtaaggttatctaacatggttttttgcgttcataatgtcgctttttcaaaggggtgtcatgcgactttatatccataaaaagagcgccggagcatggcggaagaaatcctgtccgggaaagagtaaaataaacggggtgagaaacactaactgcatcaggaggaatcattatgacaacatcattgaatctgcaatttgaaaaaacggctttggtcattattgatttacaaaaaggtattgtgccgatggataaaagcggtaccgttgtgccgaacgcgaaaaaattaattgatgtgttccgggaaaaaggcggatttatcagctttgtgaacgtggattttcatgacggagcggatgcgctgaagccgctgacggatgaagaggcggcgggccattcggctccgccggcggattgggctgaatttgtgcctgaaatcggagtgaaagaaaacgattataaggtaacaaaacggcagtggggcgcgtttttcggcacggacctggaccttcagctcagaagacggggaatcgacacgattgtgttatgcgggattgcgacaaacatcggtgtggaaagcacggcgcgggaagcttttcagctcggatatcagcaagttttcgtaactgacgcgatggcgacattcagtgatgaacagcatgaagcgacactcaagtttatcttcccgaaaatcggcagaagccggacgacggaagaatttatcgcacagacaaaatgacaatctccaaaaaaagccgcgtcctgttcttgacggccgtggcttcggggacgatgctgaacccattgaactcgtcgatgatttctcttgcgcttcacagtattcagcatgaatttcacctgtcgtttacaacggtgtcctggctgatatcgtccttttatcttgccagtgcggtggcgcagcctgttaccgggaagctcggtgatatgctcggcaggaagaagctgtttttgatcgggcttctgcttgttgccgtctcggcggtcggcgcgccgtttgcgccgactttcatgactttgctgatcatgcggctttttcaatcgatcggtagcagtgcgatatatccgtccggcgtcggattgatccgttcaaatatacgggagaagcaggcttcggcgctggccgtcctgtcaatctttgcatctgccatgacggcgctcggtccgactctcggcggttttctgatcgtttggggagggtggccggcgatctttttcgtcaatctgccgtttatcattctcagcttttttctcggaatgtatatgtttccgaaagatgaaaaacgcgagatcggccgcttgaaaggcgtgctccgccagcttgatacgatcgggatactcctgtttgccggggcgattatccttctcctgtcgtttttattgtccttcagtacgaagcctcattatacagaaggtgtattcgggcttttgtttgtcgggctgtttatctggcgcgagctgaaaacagagaagccgtttattgatgtcaggctgtttaaaacgcatcggaaactatcgtcggtgtatattcaatttattttgctgaatatattcttttactgcatctttttcgggcttccgagctattttcaggatgaaatgcatttgtccgttcagacaagcggattgattatgctgtttatgtcgggcatgagtattctggtgtcgcctctgaccggaaaatggatagataagaaagggcttcttcagccgattgttgccggaacctgcctgacagcgatcggggcggtgctgttaacgtttttctttcttcaggcgcctatgataggaaaagggctgatcctgtccgtgctgggtgtcggctacggcttcggaaatgtcacgtttcaggcggccatgctgaaaacgagccccgccgacatggtcggaacaacgtccggcctgtttcagacctgccggtatctcggttcgattttgtcttctgtcattttgggcattcttttcggaaaagaaattaccgccggccattttcatatgctcggcacgattcttatcgttgtcggcgctgtaagccttttgatggcattccggttttcggttctcctcaaaaaagcctcttaacaggcgcaacaaaaagagacgggctctccccgtctctttttgttgtgtaatgtgctcaaaaatcaaaacgattattgtcgacagcgaccaatgttatttacggaatttccagttatattttttcacatgtgatgtaaggaaaacgtacatgcgggagggagaaaatgacaaaaacaacgagtgatcggctaagcaacaaagatttactgcctttagaagacggcgaacggacatggaaagcagtgaattttgcatccatctggatggggtgtattcataatatcccgacctacgcgactgtgggcgggctcattgcgatcggcctttctccgtggcaggtgctcgccattatcgtgacggcgtcactgattttgttcgccgctttggccttgaacggccatgccggaacgaaatacggcctgccttttccggtcattatcagggcttcttacggaatatacggcgctaacattccggcgcttctcagggcgtttacagccatcatgtggctcggaattcaaacatttgccgggagtacggctttacacattctgcttttgaacatatggcctggctgggggagtctcggcggagattggaatatattcgggcttcatctgccgggctttctgtcgttcattttcttttggggcattcatctgcttgtgctgcggcacggcatggaatcaatcaaaaaatttgaagtgtgggcgggcccgcttgtttatctcgtcttcggcggcatggtctggtgggcgatagatattgccggcgggctcggaccgatttactcacagccgggaaagttccatacattttctgaaacgttttggccgtttgccgccggagtgacgggcattatcggaatatgggcgacgctgattctgaatatccctgacttcacccggttcgccgcgtcgcaaaaagaacagattcgcggccagttttacggcctgccgggaacgtttgcgctgtttgcgtttgcgagcattacagtgacatccggatcacaggtagcattcggagaaccgatttgggatgtggtggagattttggcccggtttgataatcctttcgttattgctctttcggtcatcacactttgcatcgccgccgtctcggttaacgtggcggcaaacatcgtgtcaccggcctatgacttggcgaatgtcctgccgaagtatattacattcaggaggggagggtatttgaccgccgttttggctctgttcacaataccgtggaagctgatggagagcgccacgaatgtttatgcgtttctcggactcatcggcgggatgctcggaccggtggccggggtgatgatggctgattattttatcatcagaaaaaggcagctctcagttgaagacctttattcggaaaccggacagtacacttattacaaaggctataattaccgggcctttgccgcaacctttctcggcgcgtttatttctttaatcgggatgtacgtcccggcgttcgccggcatctatgatatttcctggtttgcgggtgtcattttgtcatgtctcggttatacggcgcttatgtacattcatcctccttatgcaaaagcggagggacgaatcgtgcgggaaagagcggccgaataaaaaaagccgggggctgtccccggctttttgtcatatcagtctgcgattgaaacgtttccgtccgcttcaagcggcgttctttttttctggctccagccatacaggagcaatgcaatcaggacgaacagccccgcggccagataaatcgaatggaatccggccgaagcgacgaagaggccgaatacatatgacccgccggcaatcccgctgtcaaagaaagtgaagaaggtagccgtcgcaaagcctgaacggtgtccgggcgagttctgaatcgccagcgtctgcatacacggtacgatcgagccgtatccgagaccgattacggcaccggacaagagaagcatgagggcgctgtttgtcatcgccagcatgcaaagccccgcggagaacacgataatcgacggatagatgacgattcccggccccactctgtcaaacagctttcctgtgaaaggacgggcggccatcatcgtcactgcgaaacagacgaagaaatagccgctgacatccaacaggtggatcgtctttgcataaacggataaatatgaagtcacacttgaataacagaaagaaatggacaacccgacaatcgcgattttaagcgcgcctttttcaaacatgtcggagaaagaaaaacggaagacagtcgttccgctgttgttttgatccggcacacgaatcataaaagcaatcagcaagcctaaagaaacaaatacggcaaaaatcgtaaagaaaaccgggaacgatatgactttcacaaggctcagcccgagaaaaggaccgatcgccatggcaaggttcatagacatcgcgaaataaccgagcccttcgccgcgccgcttggcgggaataatgtcagcggcaattgcgcccgtgaccgtcgttaaaatgctgaaccagatgccttggaaaaaacgcagtccgagcagcagatagaaattgtgtatcggcaaatacagataagaagacagggcgaacagcgccagagatacaatcgtcattcttttcttgccgaaccgttcaataatcgcccctgaaaaaggacgggtgataatagcagataacaggaacaggctgatcaaaagccctccttgcgattcactgccgccaagctcctgaatcatatagataggcagcacggccaaaaatgtataaaagaacacaaagacaaataaattcacgagtacgaccataataaaatctttggtccagatcgagtcagatttactcaaaagtacagcacttccctttctttattatttcgttaaaaacacattcagaaactcagaaaaagcttccttatctccatcctggaaatccgcaagcatgtcttcctcgaacttcagcatctcttgattgatgctgtcgtatttcaattcagcttccttcgtcaggacgacgagcttttcccgcttgtcttctccctgttcccgctgaatccagccgttttcttcaaggcgtttgatcgttctggtaacggtcggcgcctctacgttcagataggaccagatttctttttgggtcatcggtccgatcgtttttaagcaatataggattgaccattgagaggagtacaggccgaatggttccagccgttcattggctttcttcgtaatcaggcgggcgcattgattgatttgatgaatgaggcgtctgttgacgtggatcatttccgttctccttttcaaaaaacttacctaagtaactaattgtgctgtttcattctacagcaggatcgcgcggatgtaaaccccccgttcaaaaagcagaaaattatgacccgccccttgtccttattgagtttttagcatattcccaattcattgctaatacactgttacaaacctatcaaagagagtgtttgaggtgagggatcgtgggcatatttctaaaaccttcttatataatcggacaacgaagaagctgcatcatcagtgaatttgttacagaatacggatctcatttcacacttctcacatccaactggggaggtcgagtggtgtgcacgattacatcaaagagcgaacaatcaagattggtaagtatatcgtggagacgaaaaaaaccgttcgtgtcattgcgaaagagtttggtgtttccaaaagtaccgtacacaaagatctgacggagcgcctgcctgaaattaatcctgacttggcgaatgaagtaaaagaaatactcgattatcataaatccatcagacatttaagagggggagaggcgacgaaattaaagtacaagaaggatgaaattcttgaaggggagcccgttcagcagccgtagcgcctgacgtctgccgggcccttttttctcctcccgggcggtttcgcgaatatccgcaaaattttgtcaagaacttatatcgttcagcagcttttttttgataaattatgataatatatataattagggcacaatgtggatattttactgtgaaacagatatcaaggaggatataaatagatgtttgcaagggatattggaattgacctcggtactgcaaatgtactgatccatgtaaaaggaaaaggaattgttctgaatgagccttccgttgtggcacttgataaaaacagcggcaaagtgctggctgtcggtgaagaagccagacgaatggttggacgtacacctgggaatattgttgcgatccgtccgctgaaagacggcgtaatcgcagacttcgaagtaacagaagccatgctgaaacatttcattaataagctgaatgtaaaaggacttttctcaaaaccgcgcatgctgatctgctgcccgacgaatattacatccgttgagcaaaaagcgattaaagaagcagctgaaaaaagcggcggaaagcatgtgtaccttgaagaagaaccgaaagttgccgctatcggcgcgggtatggaaatcttccagccgagcggtaacatggttgttgacatcggaggcggtacgacagatatcgcagttatttctatgggcgatattgtcacctcctcttctattaagatggctggggacaagtttgacatggaaatcttaaattatatcaaacgcgagtataagctgctgatcggtgaacgtaccgctgaagatattaaggtgaaggtcgcaacggttttcccagacgcacgtcatgaagaaatcaccatccgcggccgtgacatggtttccggtctgccgagaacgattacagtaaacagcaaagaagtagaagaagcccttcgtgaatcagttgccgtcattgtgcaggccgccaagcaggttcttgaaagaacaccgcctgaattgtccgctgacatcatcgaccgcggcgttatcattaccggcgggggagcgctgttaaacgggcttgaccagcttcttgccgaagagctgagggtgcctgttcttgtcgctgagaacccgatggattgtgttgcggtcggaaccggcgtcatgctggataacatggacaagcttccaaaacgcaaactgagctgatgataaaacctcattctgaaaaagaatggggtttttttctgtcaaacccttcacgaacgggaatgtaaatccgataataagaaaaaatgctgattttcattatagaacaaatgttccggtgaggcaactggaaataatgctatttcagaggtggaagacttgttaaaaggattatataccgcaacgtccgcaatgattacacagcagagaagaacggaaatgctgtcaaataacatcgcaaacgcgaatacatcagggtacaaagaggatcaaggttcaatccgcgcctttcccgagatgcttctgagccgaatagaaggcgataaaaaaacgaaaatcggctccgtcaacacaggcgtatacatgcaggagctgaaaccgttgtttacgcagggaagcctgaaaacgaccgatcagccgacggatatcgcgctgatggagaatcaggttcccaagaatgccgaaacgaatgaaaacgccgagctgttttatcccgtgcagaccgcgggaggcgtccgctattcaaaaagcagcactttctcattaaatgaaaacaatcagcttacgataaacggaaaccttgtgttatcaacaaacggacagccgattacagtcgacaatgaaaaattcaccgtatcagaaaacggaacggtcacgacaaacggccggccggcggggcagattgatatcagaatggaagaagacgtgcgcaatctgaaacgggacggcaatgacctatacagcacggccgacggctctgaactgccgagcgcggcggcgaatccccaagtctcgtattcattaaagcaaggcgtctcggagctttcgaacgtggacgtgacgagcacgtatacagaaatgacggaagcatacagatcatttgaagccaatcagaaagtcattcaggcttacgataaaagcatggataaagccgcaaatgaaatcggcaaagtgtaacaaaatgggggacgttcaattatgatgctcagatcaatgctgacggcttcaacagccttaaatcagcttcagcagcagatggatacagtcagcagcaacctttcaaacagtgatacgacaggctataaagcgagggactcccgcttttccgagctgatcagacagcagtatgaccatatagatgacaaaaaggaaaattcgccggacatgcggaaaacgccgcccggcctgcgtctcggcgccggaacggtcatgactccgcagctggactcagggcagggaagcatcaaaaaaaccgaccgtgaccttgatatcgcgttcacatcaccttatcaatatcttcaggcagaagcggacggacggcgggtgtatacaagggacggctcactttccctcaagccggcaggcggaaatgaccggctgcttcagctgatgacagcgggaggcaatcccattctcgatgagaacggtcagcccatacaaattgacagttcgctgactcagctgaaaatcagcaaaaccggaacgctgactgcttcagaccaggcgggaacccgttcgcagacgtttaatctcggcatcgtcaatgtcaataatccgcaggcgcttcatgcggaaggggataatctgttttccgtaaacggcgcgggagcttcagcgattgaagagcttaccggcgcaaaccggcaggcaatcggcatggagcagggcgcgcttgaaagttcaaatgtcgatatgtcaaaagaaatgaccgacttaatcgtgtctcagcgttcctatcagctgaacagccgcacgattacattgggagaccaaatgctgggcttaatcaactcagtcagataaaagaaggggcgttttgatcagccgcgcatgataaaaaatgcggctttctcaaaatcgcccttttttttgtagtaatcagtaatatcctgaagcagcacttccaaatccacccacgcttcaattttctgcagctccagcacaagcttctgcaatcggtcgtacgggtcctcctgagcggtgtacagtatgttgagcgcggtcagcttcaatttcataatcttgttctgcactttttcagatatgtataaacctttctgcagcacggtttgtccttcggcggcagaaccggttttaaaaagtgctctgaccgcttcgtatacacaatgaaggtaggaaacgggagactctttctcgaaacgctgattgcccaatacctttttgtaaaaagggagggcctctttatcttttttctgggcggtctttaaaaaaccaaaattataataggcgtggcacagcaggttattgtcattgatccggtccgttatctttatggattcattaaagagctgttccgcgtcttcatagcgtgcctcgtctatataattcacggcgagaagcagccggcagctgagcgtttttttgatgtagccggcttcatcttgatagatttccagcgctttattgacatattgaatggagagcgcaggcgacttcatcatgtaatatgcacccgctgttttataataaaattcagcggcttcgaaacggtcctgtatggccggcaggtactgttcagcttctttaaagcggcagacagcacggttcggagcgccattcaccatatggaataaccctttgaaaaaatagaaataataagttaattcatgatccatctcatctttgcgccgcttcagctcgcagaacagtttattcagaccgtcttttttctcaaacagcagctgaaaccgtgcgaaaaacagctgatatctgagtttgagctttgcattcttttgtaatttggggagatgctgattgatttgttcgtgaagggaacgggctagatcgaattggcgttttcccatggcgtcataccactcattcagcatcacccgcgtacgtttttcagtaaacttagcaatcatcttccaacctctttgcatagggtaaaaatctttatttatcataacacattaatggacgaggctcattgccagctggttacagtttacagcgcggttgaaaaagaaattgattcataatatacttccaaatgtacagattggttgccacatataccttctatacatactattgtcgatgaaggagatgtcaagagaatgcttgatactcagcaaattaaagaaattattccccatcgctatccgtttcttctggtagacagaattacggaagtcgaagaaggaaaacgggcggcgggatataaaaatgtgacggcgaatgaagattttttcaacggccattttcctgaataccctgttatgccgggcgtattaatcgtagaggctttggcgcaggtcggagcggttgcgatgctgattaaagaagaaaaccggggcagacttgcattttttgcggggattgataactgccgtttcaaaaagcaggtaaaaccgggtgacaagctggagcttgaggttgatattacccgcgcgcgcggtacgatcggacgcggcaaaggcgttgccaaagttgacggcgagctcgtgtgtgaagctgaattaacttttgcgctcggagaataaaaacaaacaaatgggcttataaaaaagcccattttgtatagaaaggggtgaatctaatgtggtcagaatttaaaagctttgcgatgcggggcaatatcatggatctggcaatcggtgtcgtcatcggcggcgctttcggcaaaatcgtgacgtcgctcgttgaagacatcatcatgccgcttgtcggcctgcttcttggcggtcttgacttttcagggctggccgtgacattcggcgaggctcatatcaagtacggaagcttcattcaaacgattgtgaacttcttcattatttcattttctatttttatcgtgatccgcacaataggcaagctgagacgtaaaaaagaagcagaagaagaggctgaagaagccgaggaaacagatcagcagacagaactgctgactgaaatcagagatctgctgaaacagcgggctcctcacaatgactaaggcacaaaaaaaggctggatgattaacgtccggcctttttcatgattataatttttgtttaaacgcttcaatcagccggctgcccgagtagccttctttcacgagcgactccagaatgctttctgatccggggtggtttcttgacaccatttgaccgtaaattaaaacttgtatacttctttccagctcgacgatatttttgatgcttcccgtcagctgggcgggacggttgctttttttcgtaatcgttacaaacaccttcgcttctttctggcttttcatcagcatgtcaaaaaaagaaaagtgttcggccgggaccagtgcttcaattaaccagtgattttctccgtcctctttgttaataatcaatccgtctaaaaggggaaactgctcaatcggctgatcgtctttatctaaacgttccacattcagatcaaccagtttaaaggttttcatctcttattttcacccctgttgtccatgtttttcgttcatttattataacacatatcatttttcccgggaaaatgctgtaaggcatgcttcatcatttttgtaggcggtcaacatttaatcatttctattttttcattataatgtaaaagaatatggtcatggagagatgcttatgaatcaattgcgcctgaaggaaatctatatagaagacggttcaaggcgaaaagacgatcattcctacttggtatgcaaaaaggaagattgtgaggtgcatcttaacagaaggggaaatgtcgtctttttatatgaaacaaaagaccgcatggaacagtataaaattcagctttcactgactgataaaaagctgagtttttactggttcgcatgggacggcggaaagtttgtccgcatgtttgagaaagactggctcaaaacgaaacttttctcgcggctgctcaaaaatacatattacataagcggtcaaaaacaaaagttttttttatcagaaagaaaaacgaaaacataagagcagcctaaacggataacggctttttccgctttttgctttcacgagcccttgtactacaatgaagccagcctcgaaaaagagaggaggatacggcttgtttaaccacgttatgcttgtcggccggctgacgaaagatccggagctccgttttacatcagcgggcattcccgtcgcgcatattacgttggcggtaaaccgcaattttaaaagcgcgtcgggtgaaaccggaaccgacttcgtcaactgcaccatctggagaaaaaacgctgaaaacacggcattgtactgccaaaaagggtcaatggtcggtgtaagcggcagaatccagacgagaagctatgaaaagacagacggcgtaaaagtttatgtgaccgaggtcatggctgataccgttcggtttatggatcagaaacggaaagagccgctggctgaatagcatgcttttttcctcgatttcccgcctttcagcgggccccgcaatacctccttcccactcgccagtcgaaagactggtttttttgtgcggaagctgaaaaatggttaaaaagaagtgattttgcttataaatacttaaaaacattgaatatattgggataaaaacttataattacttacagataagtgacgaaaaaagggaatgaggacgtgtatcaagaagaaagactgattgcgataatggaatatttgaaacagcaccggcggatcaccgcagaacagatatgttcgctgcttcatatttcaagagataccgcaagaagggaccttgtaaagctgaaagagcgaggggccattatcagaacacggggcggcgcgattctgccgtcagtgaatcaggaagttccaggctattcgggccggctgaaaaccgtttctgaagagaaaaacaaaatcggcaagctggccgcatccctgatccataaaggggaccggatcatcctggacacctcgacaaccgtgcaggcctgcgcggagcatttaaatgtcaccggctgcactgttattacaaattcgatcaatcaggccgatatcctttccgcaaaagagggaattgatattcacctgctcggcggaaagctccagaaggaacaccggtttttatacggggcttccgttgtagaaaaactgggggattatcacgctgataaggtgctgatcggcgttgtcggcatctcggaaaacggcctgacgattccgcatgaagaagacggcatggtaaagcgtaaaatgatccgacaggctgaacaggtgattgcgctgagtgatcactcgaagcttggccgtacgagtttttatcagtatgcagacctgcacgaggttgacctgctgattaccgatcggctgcctgatcaggatttttgcgatctgctcgaccggcacggcgtagaattgcttgtaactgaatctgaagaagaggatgaggacatgtgaaactgattgccatagatctggacggcacactgctgaacagcagtcatcaagtaagcgatgaaaacaagcgggctttaagggaagcccggcaagcgggaattgaaatcgtggtttccactggacgcgcgcattttgatgtgcactccatattcgaaccgctcggcataaaaacatggattatcagcgcaaacggagccgccattcatgctcctgacggcagcctgtaccattgtgaagcgattgaagaatcaagagcccgcggcattttgtcatggcttgaagagaatcaatattattatgaggtgtttacaaacaaagccatctatacgcctgaaaccggcaggcagctgctcgatatcgaaatggaccgggtgaaaagcgccaatccggaaaccgatctttctgttttggaacaggcggcttcagtgcaatacagccagtccggctttgcttacattcattcataccgtgagctctttgagaaagaagagcatctggatttttataatattctcggattttcgtttgatgagcggaagctgaaagcgggctgggaccgattcagcggtcagaaagatctcacccttgtcagctctgccgatcacaacttcgaactggcgtctcgaaacgcctctaaagggcaggcgctcaaacggctggcgcaaaagctcggcattccgatggctgaaaccgccgcggtcggtgacagcttaaatgactattcaatgcttcaggcggccggaaaaggcatagcgatggggaatgcgagagaagatattaaagagatcgctgatgccgttacattgacaaatgatcaaaacggcgttgcgtatatgatcaggaatttactgtgaaaggtatggcgatactgttcatgactggcgtgacgcattcatggcaaatgcggcgtaacagtaaggacgacataaaagaccggctcttcccgagagagccggtctttttgcgtttaatgtgattgcgccgatgcgctgagggtgaataattcttcaagctcatcggatgacagctcggtaatccaattttcactttggataatctgatcgttcagcgtttgtttcgtttcgagcatggcatcaattttttcttcaatcgttcccgtcgtaatgagtttgtgaacgtggacgaaccgttcctggccgattcggtaggcgcggtcggtcgcctggttttccaccgccggattccaccacctgtcatagtgaatgacatgattggcagccgtcagattcaggccggttccgcccgctttcagtgacaaaatcagcgtcgggtattctttcttctggaaccgttcgacgagagaatcgcgttcctgcttggacaggcttccgtttaaaaactgaaccggttctccgaatgctttttccaggaggcgcttcatcatgttgcccatctgaatgtattgggtgaaaatgaggcagctttccccctgtccgcggatcgccgccattaaatcaagcagcttttccagtttgacggatctcccgtttaacagctctgtctgttcttccttcaaatagagcgcaggatggtcgcatatttgcttcaagcggccgagcatgctcagaatcagcgctttccgctgcatcccggtcagagaagccatatgttcaaatgtatctttgacaagctgttcataaagggatgcctgttcggctgagagcgggataaactctttttgttccagcttgtcaggaagattaagcgccacttcttcatcccgttttgtccggcgcagtaaaaacggccggattaactgctgaagctggttgattcttttttcgtcacggtctttctcaatcggcagcacatagcgtttatgaaagccggtcagactgccgagatagcctttgttcataaaatcaaagatcgaccaaagctctgtcaggcggttttccatcggtgttccgctcagcgcgatatgatggacgcctttcagctttctgatcgcgcgggactgcttcgtatgcgcgtttttaatattttgcgcttcatcaaggcagatggtgctccatgtcacggaagaaagctcttcctgatcggcgtgcgacaggccgtaagaagtaagaacgacgtccgcgtcctgataggacgggacaaatgcttcccccttcggccggcgggggccgtaatgaagcacggccttcagctgcggcgcgaaggtccggagctcacgctgccagttgccgagcaccgatgtcggcgcaatgattaaggcaggcgctttttgccggtcgctttccttcacatggagaaaataagcgatcatctgaatcgtctttccaagtcccatgtcatctgcgagacaggcgccgaagccgttttcccgtaaaaacagaagccagttcatgccgtacatctgataagggcggagctggccctgaaacgcggcgctgacttcatgttccggcagatcccgggcttccgtcagtttgcggatcaggcttctgagatgctttgataattcgatcttgatcccggcaaatgccgatgagtcaatgatgtccgtgtcctcggctccgttttccccgtgatccatcagttcgcgcgccagcacgtcggacatgtggaggccctcagattccgctttttccatcagttttttcatttgtttaatgaattgaggatcaattttcacccattggccgcggatgttgacgagtcgtctgttgtttgcgacaagctcattgaattcatcctctgtcagctcaattccgttagtggcgaatctccagttgaaatcaagcagagcgttcatgccgacgaaggactcgccccgcggggaggatgacactttcgccttgagcatcatattgctgtcccggacaatctgccaccatgatgggagaagaatctccacacccatatcgacaagcgtctcactcgcttccgataagaagatccaagcctcttcttcagaaatcagcgtcgttcctgaatcaaacgaaagccagggaaccgttctgcggaagcggtcctgttcgcgcgcgatttttccgctgtatgcctgccacgcttttttcagtcccttcagtccgtcaaaaaaggtgatggagccggtttttttctcacgtaaaaacatttcgattttccagtcgtcaccgtcgaaatcaggctcgtttaatcggagcccgacggtaaacggcgtcagatcgtcatgccagccgattccctcgagaaaatcatcttcatccaaaaaggagcctttaaacgtatgaacggccggcgagcgggtttcgatccgccgccatttttccagcaggtcatcattgtactgaatgtagtcctggaccgcggctgagaaccagtctgccgtaaagccttccagcaaaagctcacggtctttgaagcgcaggacgccattttgccaagcctcatagtccggaagaaaatcgccgtcggcaataaattcgtatatcgtcgaagccgcttcgattaatggttccgtttcctttgtcagctgcacggtgctgaatgaattgaacgagttttttccgagcagctcgacggtcatccacgggctgagcagaacggccggagtgcctatgaagctgacgtcttcaagaaacgttccgtaaaaggtggactcatgccattggaacaaatgagtcttcatctgactgagagtaagcggctgctccttctcatcatggcttgacagcgtaaatgtccaatcttccatttgttctacatgaatgaaaatttccttaagactcgccatcaatcaactttcctttctgcaattcttcttgaagggcgcgcagcctcttgtaacttgcgctcagccggctgatataccgttcccatacctgctgtttttttgcctttttataaagcgtccgcagttttttcagatggcgcgcagcctctttataggcgctgcggtttttttgatcgataaaaaaggccgccgcccggtgataggaggggatgagcgcttccggatcactggcggcaatttccttcaggatgtccttttcgatttcccagacggaaaaaccgacgaggctgtgaatctccacccactccgcgtaccgccgtttttcgtacaggtactggctgtattcggtaaaggtatagggaaggcagccggaagcaaaccgttcaaacagctgatcatcccgtgagtgccgcgcataatccgccaatagcgcaaacagctctccgatgatgtcgcgcatttctttaaacggcttatcaagcttcgtatagttgacggcaagcggttcgatccggccataccatgctttcagccgtttccagtcttttttcgcggtgagttcaccgagccattgaaaggtatacggcagcgcttcaggagggaagcgggacatatcttggaagaccgcttcatcatctttttgcaaaaaggccagatgaagccgtccgaaccgcacttccggtgaaaaacggcgcccgctttcctgtgcgagaatctcctgttcgcgcgcgacccatttcggccggttcaaaagggcgctccacatttcaccgaatacccggaggcgttcgtattgaaaaagctcttctttcacaagcagtctgcgcagcaccgggggcgtccggtctaaaaaaggatcgagtgaaaaagacaaggcgtacgttttcagtctgtcaatggaggaataaatcgtatccatcagctgttccacgtatggattgatgctgtaataatctttttcggcatccaatctgcctgactcaatcaaagtgaacatgtgaagccagacggcaagcgccgaatgaatctgatataagcttttaagctcgggttttttcggggcgtgttttttgagcgctgacagatagccgtaataaaggccctgcatcgtctggcttccggccggcgtccgcgcctcccacagcgagaattccgaatcaaaaaaagcgagccagcttgacagcgactcttcattcggcagcactttttcctgaaactgccggcggacaagctccctgctttcctcaagcttttctctttccagccaatgttcggtaaaggtaccgacccgctcgaattgggcatatacgtaaagaaaaacggccagtacgtggcggcagatcgcctcagacgggcatgcgcagccgcttttcaccatgaaaaataagttcagcgtgacccttacaggcacaacatcctgcacatatgcggaaatctctgtcggggtttgaacctgtatacgatagacggaatcctgccgatataaaatgagtgctttcttcatcagctgaacattgtcttcattgtaaggaagaagttctttaagctgttcagccgctgcgagcacatcttctttagcaatcatatcctgaagcatgattatcgctcctaacgagtcacaaaataaaaagattccaattcctctattatatcgcaacacatggcccggaaaaagtttttcctaaaaaaggacataaaaacccgaatgtgtcgaatgatgtattagagattgcaaaacagcacccgacagcatataataatcttgttttcaatttaatggaagccgaaaggaaacgaatgatgaagaaaacgaagttagatcaagaggagtttctgaagattttaatgcatgcgcacgacattggtgagcagtcctctgagatgaccacaaaagaaatgcttgagaatttgatttcttatattaaaaatggatatgcaacataaaatcccgcaggctcttggccgcgggattttttaatcttcctgtaacaccagtatttaaagcgcttacaaaaataaaacagattgaagtgattgtctatttttgtcgaattttgtcatttgaaaaggttagaaatgacagtttaaagctgtataatcgtaattggaaaagatcattggagggaatgggaatacgcggaaagtgatatggaggttatatgggagaatctacaagcataaaggaaatattcgcaatactgagaaagcgtctgctgtttatacttattattaccgcggcggcatctgccgcaggcggactcatcagtttcttcgctcttacgccggtctatgaaaactcaactcaaattttggtcagccaatccaaaaacaatcaaaaagaagtccaattcaatgacgttcaaaccaacctccaattaatcaacacgtataatgtcatcatcaaaagcccggtcatcctcgacgaagtgattaaacagctgcatctgtccatgacttcgaaagagctggaatcgaaaatcacggtatccagcgagcaggattcacaagtcgtgacgattgccgttcgggatacggatgctaagcgggcggccgttatggcaaatgcggttgcatccgtttttcaggacaagatcaccgccatcatgaacgttgataatgtcagcatcctttcaaaggccgaagcgtcggacagccagtcaccggcagagcctaaccgtaagctgaacatcgcgattgcgtttgccgccggacttttgggcggaatcggtctcgcctttttgctggaacatctggataatacgatcaaatcggaagaacagctggaagcgctgctcggcatcccgatcctgggaacggttacttcaatcagtacaaaagacagcgttgccaaaaatgtgaggatggcggaaaccaaacaagcgggaggcggacatgttgacgcgtaaaaaagacaaacccggaaaacgaagcgtgattgcgatgtctgagccgaaatccatcaactcagaacaatatcgcacgatccgcacaaacattgaattttcttccgttgatacggaggtgaagtcccttttgatcacatccgccggtccggaagaaggaaaatcgacaaccgcggccaaccttgccgtcgtatttgcacagcaggggaaaaaagtgcttttaattgatgcggatttgcgcaaaccgacggttcatttcaccttcaaattggataacggaaccggattaacgtcgctgctgttaaaacagctgccgtttcagaaagccgtcctgccggctgatgaagcaaacctggatattttaacgagcgggccgatcccgcccaatccggcggagcttttatcgacgggcgccatgaaagatcttctatcagaagcagccgcagtttatgataaggtgattttggacacgcctcccgttttggccgtagccgatacgaaaatattaggcagctacactgacggggccattatggtgatctcaagcgggaaaacggacaaggaaaaagcagccaaggcgaaagaagcgctcgattactgcccgtgcaagctccttggggccgttatgaacgggaagaaacaaacgaaacattcggactacgcctattacggacaataatgtcacaatgggcgcggtccattctttttaaggagggattgaaatatgatagatatccattgtcacatccttccttccatagacgacggcgcggcggatgatacagaaagcctgaagatggcgagagaagcggtcagacaggggattgatacgatcatcgcgacgccgcatcatgtgaaataccgctatgacacggatcggcatacggtcaacgaagcggtcagcctgttaaacaaacgtttgaataaggaaggcattccgctgactgtcctgcccggccaggaaatcagaatagacggagatctgctggcaggtcttcaaagcggctcgcttgtcccgctccataatacaaagtatgtgctggcggaatttccggcggatcatgtcccggcctacgctgaaaggctgttttatgaactgcagctgaacggatatgtccccgtcatcgcccatccggagcggaacagggaaattcgcgaaaacccttccgtcctttacagtcttgtgaagaaaggggcggccgcccaagtgacggccggctgcattgccggagcattcgggcggaaagcgaaatccttttcgctgcagctgatggaagcgaatttgatccactttctcgcatctgacgcccataatctcggaccgaggaatttttattatcaggaggcgctcggcgttctgaaaaaagaagcaggggcggagctgatttacatgctcgcggaaaatgcggcgcttctcgctgaaaacaaagccatttataaggaacctccgctgcctgtggcccgccgtaagcgctggggtcttttttaatcgtcgtctccatcccgtttaaatgaagcgtaagcggctgttttgcaagatgattcgtttatgcttatgctattatcagcggccggcgccgttttttcctatcatggcctcaggcttccggcattccgccggcgccgggatcatatgataataacggtaagctgcccagcagcaatttctaaacggttgggggaacacgatgaaaataacagtgatcggaacaggctacgtcggtcttgtgacaggagtgtctctttcagaaatcggccatgacgtaacatgcatagatattgacgaacgtaaggttgagcagatgagaaagggattgtcccctatctttgaaccgggccttgaagatatgatgaaacgaaatatcggccggcatcggctggcatttgaaacgagctacgaaaaagggcttgcggaagcggacgttatttttatagcggtcggaacgccgcaaaaagaagacgggcacgcaaaccttacttatattgaaaatgtcgccgaacggattgccgaacatatttctaaagatgcgatcgtcgtgacaaaaagcacggttcccgtgggaacgaatgacagaatcagcgaagttattcattcacggctgagagcggacgtgaacatttcaatcgcttcgaatccggaatttctccgtgaaggttcggcgattcacgatacctttcacggagaccgcatcgtgatcggggctgaagaccggcagacgcgggaaacgcttgaccgggttttcgcgccgcttgcaattccggtatatcatacggacatcagaagcgctgagatgatcaaatatgcgtcaaacgcatttttagcggcaaaaatcagttttattaatgaaatttctcatatatgtgaaaaagtcggtgcggatgtggaatcagtcgcacacggaatgggattggataaacggatcggcaatcaattcttaagagccggcatcggttacggcggttcctgttttccgaaggatacaaacgccctcgtgcagatcgcgggacatgtggagcatgattttgaattgctgaagtccgtcattaaagtcaacaataaccagcagtccatgctggttgataaagtgctgaacaggctgggcggtgtgacggggaaaaccatcgcgttattaggactgtcttttaagccgaatacagatgatatgcgggatgccccgtccattgtcattgcggatcgtctggcggctcttgacgcccggatgacagcgtacgatccgatcgcttcatttcgggcctccgagctgcttccggctgcggtttcctatcgggagtccatagaagaagccgtcaggggagcggatgccgtcctgattctgacagattgggaacaaattaaacacttcccgcttgaagcgtacaaagagctgatggaaaccccggttattttcgacgggagaaactgccactcgcttgaggaagcggaacaggcgggcgtggaatatatctcaatcggaagaagagccgtcgtgcctcagactgattctgtcacttaaaaggccggcggtccgcgccggccttttatcatacaatcattagagacgaaggggacattaatcgtggaaaacacatggaaattgccgaagcaaatggaatcatcccgcggtctgctggaaacgtcagcacggccctttatcaaactgcacgtcaaaaaagctgaaacgggtcggtatgacagtaaaatggccggagacccctattttccgaaacatgaaccatatcctgaagatgaaagcagcaggccgatgaagcttctcgctcaaatcaattttgcggatatgcccggacttcctgattttccggacaccggcattcttcagttttacatatcggtcagtgatgacgtatacggtttgaattttgacgacgggtgcgcgcaaacgggtttctgcgtcaaatattttgaacatgtgacagcagaagaagcggagctcatggatgatttttctttcgttcaggttgaagaggagtacgattttccgattcaatccgaagcgctgatcacccctgagctgtctgctgaatgggtgctcccgtctgattttcaattcgggcggtatgccgggatggatgcctttgactatttcgagcagtttgacgatgaggtgtatgacgaatatacggcgaacgcattcggccataaaatcggcggctatgcgtcctttacccaggaagatccgcggtcttactcccatcaaaaccatacgattctgcttttgcaaattgattcagatgatgacattgattcgatgtggggagatgtgggaatcgccaatttctttatcagaccggaagatttgaagaaaaaagatttctcaaacgttttgtacaactgggactgcagttaacgacagtatgatgatcatgatacaaggcaaaggagacggttcatcactgtctccttttttagggaatttatcatggatacatagaggagatcaatgaatggatatgccgtttatgtgagtcttttggcgttaatgatgagcatctcggctgctgaaaataagtcatttaacctatttaagctgctttctgtctattttaaaatataatatatggaaatatagtatggaaaagtctgtgctttttgtacgactttttgcgtaagacgaggtgaaaaagatgagccattcaagcacattaagccatattaacagcacaatcagccataaactgggcgaggttgaacaccaaattgataaattaaaagaagcgaaaagagagatagaatctctgcaggaagagggcgtgtctgaaatcagggacatcctcaggccgcacctggaccatcattggaccggcacttttgctgaagaatttgatgaccggcgcgatcaggcccatacagaagcatacagaatcgttacagacaaatacgacggttatatttaccgaatcggcttaaagatgacacagcttgaaattgaaaaaggagggctccttgccgccagaagcatcgcgagagaggcagagcacctgctgacgctgggagaagaagcccttgacacggtcggagaaaaaatacaatcaatcaaaagaagctggagttggttttaatggcagaaataaaactcaaatacggagccgtcatgaagcagcttgaatccgtcagcagcgctttggaggctgtttcgatcgggaacgccggttcaaacggaaaaaacaagctcgactatacctccaagtaccaatcccgcgaggcaaagcttgtatcgatgatcagcgaatacaagcaggccgttcataagaatatcgcggacgttaaagacaacgtagattctttgaaagaacaggacgaggcgatcgccgtaaaataacgaaagaaaggacttgccgatgagcaaagtgtttgaatcacaatcgttaacggacgaagcagataagagaaggaaacaatacgaagcccttgaagaacagctgcgtgcgctcaaacaagcctttcaaggcgtggccgatctgggtgatgctttgaaagggaaaggcgcagacaatataaaagatttttttcagggacaagcggaaatcgccgacagctggctgacgcttgtctctgctcaaattgcgtttttaaatggcatttcaggtgacattaaagatcaagaactcagcgatacatatgtggagacttcatttttggagcatgagctgcccaacgcggatttgaaagcttcagagattgtctccgctcataaagcagaaatcgattcgattttgtctggcatcagcgatattattcatctcgatacatatacgctggatgattacgcagataaaatgggtgatgcccagaaaaccagacgtgacacgatcacggcagtcgatacgcttgatgaatccctgaccgctgaatatcaaaacttagaatctctggacaacgcagtgctcagcaaatattccgttctcatgcaggccaccagcaacgggaaaagcgcctcccctatgtactatgacaaaaaagccttccacagcaatgaaatctacaaaagcgtcatggcgacagaaaaacagggcacggactatattgacgcaaaagcccagcaggccgaagcaagacggcttcaggaaaaggctgaagaagaagccaataaaccatggtacgaaaaaacatgggacggcatctgcaactttaccggcgaagtcaccggctattatgattataaaagagcagccgaaggcgttgatccggtgaccggcgaaaaactctccaccgcagaacgcgtcacagcaggagcgatggccgccgccggattcataccggtcgtcggctgggcgggccgcgctttcaaaggcggaaaagccatttacaaaaccggaaaaaccgtcattgccgcagaacatgctttagatgcctataaaaccggaaaatccttagacattctcaaaatgacagaaatgggcgcatacggcctcgtcgcctcaaacggattctcagaagccgtcacaggcagagatatgttcggaaacaaagtgtctgaggagaagcggaagcaaggggcgctggaagctgcgctgagtttggttggagcgggcagtctggccaaatcggttgatcatagtgtatcaatgtatcgaaatgtggataaaggttcgacagttaaagtgaaactatcagatatacgacatgtcgtgaatccgacccatgtgaaaaaagtagctcatcaaacctatcaatcagttaaaaaacgatctttatcggtgatagaatcagctggtgaaaccgtactttttgcgaaacagctgatgggaacattccgaaatcagccagcatacgcatatgctaaaagcagccactatactgagagtttgattaataaagaagctgtcaagaaagtcgcacagtatccagttaattacctaaaacaagttgctaaagaccatattcactatattacacaaacagggaaggtattctatgatgcctcgtcgaaagtgtttcgcacaagcgatggaaaatttgcgaaaaaaccgaaagcagatcatgtagaagagcctaaggtgctgaaagttgagaggcaaaaaacagacgttcatagtgaaggcactaaagctactggtgaactaaataaagacttagcgaaagcatatctcagagatatagaagccaaaactggacgaaaggtttgtaaagagcagatcgaccatataaaagaagctttaagaaataataactatgagaaattaacaccaaaagaaacagctaagcataggagcaaattcacatcaagtttgaaagatagattgattgcagaatgggaagaaaaaaccaatcaaaagtggcctagatatacagaagaggtttttgataagcatggagaagttgcccgaagtattggtcaaccgtacgatgcccatcatatcatagagaacaactttggtggccctcacgaatggtggaatattcatccggcaaaatatccggatgaacaccaagcgggtatacatggaaagggagcaccatcaggaaaactatttccaaggaggtaaaaatagttcatggctgaatttgaatttataaatcatttagaaaataaaacatataaggtacctgaagaggatatattaaaagctgaacaaagaatgaacgtagatattccaaatgatttaaaacaattatatttagaagtcggttatggttttattaaaggtgaaagtgataatgcaattaataggatattggggccaggggcagtagccgacattagactaagagaaggaatttttgagtctgacccagatttagatgaactttatgatgatgaaaataaacttattttttttgaagtaaacgagggtgtttatatttctatagatttacgattggcaaataatccaatattttattttgacactcaaatagctgaatctttagaggatttttttaaaaagttcctcaatgataatgaatattatattgatttaattgaggattagacttaaaaatgggatagttagaagaattaattgaccttgattggctagtgaagcctttcaaggttttttacaaatgaattgttattttctgtttaagatgacttaaatgtctgttgggctatgaacccgtcacaggagaaaaactctccactcaaaggaggtaaataattgtgaaatatgattttattaaaacttacaaagaaaatacattttatcaagtaagtgagaatgaaatcttagaagtagaaaataagttaggtttaaggttaccttatgatttgagacagtttcttctagaggttggttacggctttctgaaaaaatcagaatataatattaatcgcattcttggacctgcttcaattagagatgcaagattaaaagttaatgactttgagttttatccagatatagaagtttatgaggaacttgaagaagataaattgattttttttgaagcaaatgaaagtgctttattgttaattgcattaggcaatgaacaaaacaattcaatatattacgatgatataaaaattgcagattcactagaagagtttttaatagagcttatgaaaaatgataaatattatcttgatttaattgaggattagacttataagagggaatggctagaagaattaattaaacttgatggctgctgaagcctttcaaggttttttcataggtgaattgttgttttctgttttgtgaattccgaataatttatttggctttaggctgcgttccggttaccggagagttggtaaccctacggttgtacttaggaaaggtgtataaagtaatgaaatacggacattatcataatcaggtaaaagaagttattgatttttccaaaacctttaaagcagttgcatcacatgaaatctcttattttactaaaattattaatgatgaagaaaaagctaagtactatgtttacgaagatgtaattggtgaagatgaatatgcgtggaaagatataaaagaaaacgagatgagtgaggtatggggaaaattttatgaactaaacgatgatcaaaaaccacaaaacctagacatgcttctgaaaattttttcggaaaatgtcagaagtgctacgactgaatttaatacttttcttgaagagatcgtagcagatctaaataattgtgcaataaatagagcagtaaacgggaaaacagacaatttttttgaaaaacttttcaaaatttataaagcgggcaattttccatggggctgggatggagattatccttatggaagttttattgcgttgtatatcgaaatgaagaacttgaattgaaaagacgattttagaaatgaaaacgaggaaaacaagtgaaatgaaaatacatcaaattcacgattttgaacaaaaagatgaatcggattttgttcgaacacaacaatcccttaaacataaaattaacctatctcattccatcaccccagactccgtcaacacatgcgcaggcgtcgacctcgcttattgggagcaggacggggaaccgtacggcgtatgcagtatcatcgtgattgacgctgatacaaaagaagtgattgaaaaagtgcacagcatggggaaaatcggcgtgccgtatgtttccggttttcttgcgtttcgcgagctgccgctgatcattgaagcggcagaaaagctggaggcggagccggatgtgtttttgtttgatggcaacgggtatctgcattacaatcatatgggcgttgccacccatgcggctttttttctgggtaagccgacgatagggattgcgaaaacctatctcaaaatcaaaggctgcgatttcgtgacgcctgaaaatgaagtcggcgcatacaccgatattatcattgacggcgaggtatatggacgggcgctgcgaacgcggcgggacgtgaagcctatctttttgtcttgcggacatgacattgatttagaaagcagctatcagatcacgatgagcttgatcaatcaagaaagcaggctgccgatccctgtccgtctggctgaccttgaaacgcatgttttgcgaacgttttatcggaaaaatcacgtgtaacacttggggctctaagccaccaagtgtttttttgtatgcctggtgtctgctttattaaaaactttgtcgtccttgcagataggtttttatttgaatgtttttcgcgtcaaatcgataaaagcctttaatggcgcagacatccacttgtccttatgccatgctaattgagtaaaaacagggcattcattctgccagctgagttctttcatccgtccttcggcaatatcgtcttttactgtcatttcaggcaatagtccaattccaagtccggccatcacgcattgtttgatggcttctatgctgacgaattctaatttgttagggtagactccggcgtcatgtaaagtgttctcaaagagcgtgcggtatgaacagccgtcctctgtcagcagaagggtttcgttttgaaggtctttcaatgttgctggtaaatccgcaggaaaaggatggtcattggcggctaccattttgatctcatcctgaatcaaagattcaacgtgcagtgcgtcttccgtccgattcacatccaaaatgaaggtgatatcaagctggccctgtaagagctgttctttcgcttgttcgttggaaacatacggtttgaatatgagctttacttgaggaaaagcctgtttgaattcttttatgataggcggaagacggtatgtgcactggctttccgtcgcgccgattttcaaggttccggttgtttctcttacttgatttgcggccatttttgcttcttctgttaacgcaatgatcttctccgcataggatttgaatgttttgccggcttctgtcaggatgagccgcttgccgagccgttcaaataaaggagtcccgatttcttcttcaagtgatttgatctgagaggtaacgcttgattgtgcatagttaagcatcttggcggttagggtgaagtttacatgttctgctgcggtaataaaggtgatcagctgcttcaattccatatgttctcgccctttctaaatcggttttaccgattggaataatcgaaataatcatctgtattgattgatgaatccattatatgatgaagaaaatcattcgtaaacaaaggagcagatgcatcatgaaaattgcggttattcatggcggaacgaggtctggcggaaatacggatattcttgcggagaaggctgttcaaggattcgatgcggagcacattcatttgcggaaatatcggctccagccaattgaagatctgcgtcacgctcaaggcggctttcgtcctgttcaagatgactgcgattctatcattgagcggatattgccgtgcgatattcttgtattcgccaccccaatttattggtttggcatgtcagggacattaaagctgtttattgatcgctggtcacagacgctgagagatccgagatttcctgattttaaacagcaaatgtcagcgaagcaggcatatgtaacagcagtgggaggagacaatcctaaactaaaagggctgccgctgattcagcaatttgaacatatttttcattttatggggatgtcctttaaaggctatgtgctgggagaaggcaatcgtcccggtgatattcttcatgatcatcaggcgctgagcgcggcgagcagcttattgaaaagaagtgatgctctatgaaactgctgctggttatctctggtatgttgattctcgcactctttttagcttggaaagcgccgacttctgtttggatacaggctgaaaccaattcgcctcaggttcagcaatttgtgagaatggcaggcgcaacgctgcaagtcaagcaaatcatcaagagtgatgcaggcgaagaaacagttgtcatatcaaatggtatttctgggccaaaataaaaaagcacctgtccaggtgcttttctttataaatgaggaaccacaagacctccatacaaaaacgccgcgataatcaggaaggccggatgcatcttgaattttgtcaaggcaaggagggaaatccccgcaatcactatcgcttgaacccagccgatcgctttgatgccgtctgcgccgatttgccaggtaagaatgagcatcatgacggcgatgacaggctggacggacagcgtcatacctttgatgacgggggattggcggaagcgctgaatgatgcgcaagaggacgatcaatgcgagcgccgacggtacgacagtggcgatcagcgcaatcaggaacccgggccacccgcctgcgctgtaaccgacatacgccgcgattttggttgcgatcgggcccggcaatgcgttcgcaagtgcgagcatatttgaaaattgatcgtttgagagccagctgtatctgttgacgacttcttcaaacatcagcgggatcgacgccggtccgcctccatatccgagtacgtttgcgacaaaaaacgccataaatatataaatcatgatcatgaggccgacattcctttatcttttgaacgtttatttgtgattttgtcctttaatttaaaatgaaacgcgccgtacgccaagaaaatgataatgacaaagccgggattgatctgtaacgtttgcaggccgataaaagcgatgataaaaaacaggatgcccgtgacccagccgaatcctttaagcgctttttggccaaactcgtacgccatgatgccgagcattaccgcaatcaccggtgttacagcgccaatcatgccggcaacaattgctgagtggcttaagacattgacagccgcaaacaagcccgccatcgcaagacatgtaggcagaatgtgggcgagggtcgccgcgattgcacctaatgtgcctttcagcttaaagcccagatacgcagccatttttgtggcaatcggtccgggaagcgcattagcaatcgctaatatttctccgaattcatcatcatctatccatttgtatttattgacggcttcatggcggatgagcgggatcaccgacgggccgcccccgaatccgagaatgcccgttcggaccatcgccgccgtaatgtcccaatagggatgtttcatggctatgtcctccttacagcttcatgcccgttctgcttttataccgtttaatcagcatttggcagtcgacgctgacgacgcctttttgcgtatagagccgttttgtcaaaaactcttccatctcctgatcatttgcgaaaatgccgtgcatatgcagcttgctcggtccggtcatgtgataaaggcttgtcacggccggctccttttcaagctttaatgcggtttcctccaaatactgcggctccacctccacattaaaaaacacggacacgtgacggccgattttcgccgggttgatgacagcggtgaatttttcaatcacaccggcatccagtaaatgctgaatgcggtgctgaaccgccactcgcgacaggttaacccgctttcctacgtctgtataggaaatcctcccttcctcgtgcaaaatcgaaagaatctgtttatccgtttcatcaaggacaagattcggaatgctgtattcatgttccaacccgcttcaccttccttcatttggtagacattattgtatcatgaaacattacgttatgaaggaagaatttttttattgttttcgatgcgtaataacttagaattatttcttatcgaaaagtaaatagtgtgtgagattttctttcaggaatgtggatggccgcgaagccgctttttatacttgagaaaatttgtaaaggggcttgccatgaatacttcaaccatcggaacgaaacaaatggtcgtcagtccgcattatctcgcttctcaggcgggggccggcattctggaaaagggcggaaacgcgtttgacgcggcagtggcggtcagcgcctgtctggcagttgtgtatccgcatatgacgggtcttggcggggattcattttggctcacttaccataaagaaacgggacgaatcaaagcttataacgggagcggccgttcagggaagcatgtgacgagagacttgtatcggggcagagaagcgatccctctgcgcgggacagaaagcgccattaccgttccgggaatggcggacagctgggatgccgtgctttcggcatacgggcgtctttcgctcgctgaggtgctgaagccagctcttgattatgcggcaaacggatttccggtgtccgccgaccagtgcgcccacacagaacgcaatctcgatcttttagcctcgatgccttacacctcggccatttttacgagaaacaaaaaagcgcccatgcccggtgaacggtttgtccagaaggatctggcggccagcttggagcagcttgccgagaaaggcagaagcgctttttatgaaggagacctcgctcaacgcatcacatcctttctgcaaaacaacggcggccgtctgacacttgatgactttaaagcccaccgcggcgagtggacgaacccggtatcctccgattaccgcgggtgcaaaatctatcaggctccgccgaattcacagggctttacaggcttaatgacgctcaatatattggaaaactatgatttttctcagatcgaacacggttcctttgactattatcatctgctgatcgaggcgctgaagaagagttttcagcaccggaataaagtgctgactgatccggcattttctcatattccgctggatcggctgcttgataaacggtatgcaaagcagcttgcggaagaaatcggtaacgtggctgcgccggcggtaagccggccggtcggaagcgacactgcttatgccgccgtcgccgatgcggaaggaaatgccgtttcctttattcagagcctctattttgagttcggatctgccgttacagcgggggagacgggcattctgctgcaaaaccgcgggtcatttttttcgctggacgaatcccatatcaatacacttgaacccggcaagcggacgttccacaccctcatgccggcgatggcctgtaaagaaggaaggccgcacatcctgtacggaacccagggaggagaaggccagccgcaaactcagacagcgatgattacgcgcatcattgattacaaaatggacccccagcaggcgatcaatgagccgcgctgggtctggggacggacatggggagaggagtatgaagggctgagggttgaaagcagaatcagccctgaaacgagagaagccctaaggcagagcggccaccgcgtcgagaccgttggtgattttgacgggcttatgggccatgcggcagcgatcgtcattgatgaagaaggctttctccaaggcggggccgacccgcgcggcgacggagcggccgcaggagtatagagctgcgctaactgatgaaaaaaataagcacgccaagcgcggcagaaagacctgcgtaaaacgaatcgtacacatattgcttttcctccagccggtaccgccattccattaagccgctgcagcaaaatagcatgaaaacaactcccgcaaatacgtacatttcattgaaaaaattcaccgctgcgatgcccgtaataagcagtgtgatttcgattaatcgatgtgtgccgtttatcggcttctgctttttaacaggctttggcaaattgagaactttgacggcaaatacttgaaacataaggctgagcaaaataaatacggctgaaaaaatcagtaactgagtgaaatccatcgtctgcctcctaaaaatgtgccactcgtttcatacgggtgaggaccttgtaagtttcggcattctacaagacattaggctgagttacatggtaaaagactcaaaaagaccccttttgaaaggggtctttttgactagtttcttctattataatggttcctgcttcaggtcgggcggacaagcgtatatgtcttcccgagtctggcgtattcattccccgcgagccttgccgcaggcttcagctcatctgtccgtatgtagcctttatcggcgtcatatacttggtcattcaaatgaaaacaaacgactctgccgatgatgaggtctgtcgtcgtttctccgctgtcattttggaacggaagatggcgttcgagtatacattcaaacctcacttttgcttcttttataccgggaacgctgatgcaagcgctgtctgtcacagaaaggtctgtcatgccaagttcgctgacatcaggatcaagccttgccgccgttttgttaatgtcttcaataatggactcatcactgacgtgcaccacgaattcccgatgagcgattgcgtttctcgcggtgtctttctgccgaccgtccgcgcggctgactgagatggccagaagcggcggttctgcggagacaacgttatagaaactgaagggcgccgcgtttacggcgccgttgatggatgaccgcgtagtgacaaatgcgatcggccggggaacaactgtgcccgaaagcaatttgtaagtgtcttttgcgttcagttcgtctgctcgtaagatatgcatgatttcggccgcctttctttatcgtatgacctgattatacagaaagaaaattcggaaacacaacaaaagaaaaccggctgcatatcttatcacgtggcatatatctgattgaggaaaaaggcttccgtttagccggcagcctatttacgaatggtgttacttgtagtttttctttacaacccagatgttcccgtctttccagtactctgttttgctgcagtaatcgtcttttttgcaagggtcttttttctgaggacgataaggttttttctgcgtgcgttttttcttgcggcggcatgatttcttgtggctgcgagattttttgtgagaccggcatgattttttacggctgcgagattttttgtgagagcggcgcgattttttatggctgcgagattttttgtgagaacgggattttttatggctgcgagattttttgtgagaacgggattttttatggctgcgagattttttgtgagaacgggattttttatggctgcgagattttttgtgagagcggcacgattttttatggctgcgagattttttgtgagagcggcacgattttttatggctgcgagattttttgtgagaacgggattttttatgcttgcgagattttctcttcttactgctttttggttcttggtacaaataatcttccaatccctcggtgcttgcggactttactgcttcttcgatatcagaatgggaatagtggcccattttgaaacctcctcatgatatatgttttaaggatgcgatccttactaccacatagtacgcatgaatgaaaaaagtgtatgtgtgattcgctgagttttatataaaaagcacagcctaaattaatacagggaggtttactgatgaaagaccaatcaacattgcctctataccagctgtttattcacccgaaagacttaatggagctgaaaaaagacatttgggatgatgatccggtgcccgcggtgctgagagtgaatcaaaaacggcttgacattgatctggcgtaccgcggctctcatataagagattttaagaaaaaatcgtatcacatcgctttttattcgccgaaaacatttcgcagggcgaaagagatacatttaaacgctgaatacaaagatccgtcgatgatgcggaataagctgtctctcgatttcttcgcggagcttgggacgctgtcaccaaaggcgaatttcgtaaccttgcaaatcaatggcagacatgagggggtgtatcttgagctggagtcagtggatgaatattttctggcgaaacggaatttggcggacggggctgttttttacgcggttgatgacgacgccaatttctcccttgtcagtgatctggagcgggatacgaaaacatcgctcgaacttggttatgaaaagaaaacgggaacgaaagaagacgatttatacttgcaggacatgatctataaaattaataccgttccgaagtcagagttcaagggggagatcgtcaaacacttggacgccgataagtatttgaggtggcttgcgggcatcgtgtttacctcaaactacgatggatttgtccataattacgctttgtaccggaatcatgaaacgggactttttgaagtcattccgtgggattacgatgcgacgtggggaagagacattcatggtgatcggatggaggccgattatgtcagaatacaagggtttaataccttgactgcaaggcttctggatgaaccgtatttccgcaaagcgtacaaacggcttttggaagagacgcttcagacccggtttaccattgaacatatgaagccgaaggtcatgtcactgtatgagcagatcaggccgcatgtcgcgaaggatccatataagaaagaagagatggattgctttgaccgggagcctgaagtgatttgcgaatacattaaggagcggtcagccttcatcagcagtgagttagagcggtggaatatctgatttggaaatgaagaaagattttttacaaataggctggtgaatcagttcccgaaaataatcgtgatacgtatatatgcattatgctttttacattatgagaaaaatgactaggaggacaatagatgaaacgcaatacgaagcggcagcggtctgatgacaactttttgcatgcaatggaaggaaaagtgattactgtctaccggggaggcccggagtccaagacagggagattagcagacattcaatcggattatatcgctcttcaggttgataataaaatcgtttattatcaatggaaacacgtgaaaagtgtgacggaaaatacgagtgaaaccgtatcgccggccgaagcggcagaatgtgaaaaagctgatgattttcaagacctgatcagccggatgaccaatcgcacggtgcaattgaatcagggaggtccggaatcgaaaagaggaaagcttcacgaaacaggggatgattttctcgtgctggaaacagaagatgacggaattgtatattttaacgccgaccatgtcaaaagcatcagcgcggaacaagaagaggacggccaagaggaggagcgcccggaatttgaaatggctgatgattttcacggcatatttaaacgcctgatccacaaatgggtatccatcaaccgcggaggtcctgaagccgttgaaggtatacttgtggataattccgacggccactacactcttgtgaaagataaagaagtgctgcggatctatccttttcatatcaagagcatcagcgaaggggcaaaaggcgcagctaaaaaagaggagaataaagacgacgagaataaaggtgagaaagagagcgccgaagaagaaaagccgcatgaagaagaatcacgcgaagagaagcgtacttcctctaaaaagtcgaaaagatcatcaagatccgttcgatcctcaaaacgggagaaagaggtctcttatagctacgccactgtattaaggacaatagattatcggtggaaacgcggccgtaaatgattggaaagattgtccgtaaacgcgggagaggggggaatgaaatggctggattaagcagatttctggataaacaagtcgatattgagatatcggggaatacgacattttcaggaactcttttggatatcggtcaggatatcattgtgattcatgacggccggacgtttctttatattccgctgctgcatcttcagcggatgacattgacgctcccggacgaagagaataaagaaccgtacgcaagaaaaaaaagtccgcatcccgaaaaacaggaacattcattttcttaccggaataccctccagcatataaaaggcagatttacagaaatatttgttacgggagaccgttccattcatgggtatgtgacaagtgttttaaatgattattttgttttcttctctccggtttataagactcttttcatctcgatgcatcatttgaaatggctgacaccctattccgatgagcagacgccgtatacattaaacagttcagagctgccggttgttcccgctaatgtgccccttgtccggaattttgaggagcaattaaaaagatatatcgggaagctgattattctggatttaggagatataccgaataaagtggggctgttgcaggatgtctcagataatattcttgaattgaccaatgcagacggcgatactgttttttggaaattgaatcatttaaagaccatgcacctgccataaatgataaaactgcctctcttatacagcaggcagtttttttatgggagctaaaggtaaatccaactgatccaaacatataaaacggtaatggtaaacacgacggtgagagggacaacgataatggtcgttttgatatattctgaccaagaaactttttcgccgtgctgtctgatgatatgcatccagatcagcgtggctaatgtcccgatcggcagaagcaatgatccgatatcactgccgataatattagccagataaatgatttttacggttaatgggtcgatggacatttcagttaatgtcaaagtgctgatcattaaggcgggatggttattgaacaaattagagaggacggatgtagcaatgcccataatagatgcagcgtgggcaatgctttgtgagacataaggttcaatagactgaacaagcagcgccgtcagtccgatattatgcagtccgtagatgataatgtacatcgtgaaggcaaaaataaagatatgccaaggcgctttccttaataagtctgccggtccgatttttaaataaaaccatctccagccaagcaggatgactgaactgatgacagccacgagcgaaacggatatgccgttgtaagaagctgcaaacagactgatccggacgaacaatacaaatgccaaaacacaaaacatgatgttcgtacggctgttttgggtcgggtctggcggaggctgaagcgggtgatatcgtttgtgttccagcgaatcaaaatgaaccggaatatcggggagctgtttcggcaaacggcggtaaaaaacggcaaacagcagaaaggccataaacaccagtcccagcgtgccggggataaacatcatattggtgtacaaataaaggtccatgcctatcattttgagagaaattaaattgacgatattactgacgccgatcggggtgcttgccgccgtcgcaattaatacgccgcttattaaatacggtgttttctgatgtcttttaagtccgagatattgtaagaccaatagtaaaataggagtggtgattaagacgctgccgtcattattcagaaagagcgtcattgaaaaacagagcaggttggtcagccaaaaaagccggatgcccgatcccttggcgcggtgaagcagtttggccgccgcccagttaaaaaaaccgaagctttccagcgcgatcgccataatcattgtggagataatggtgattgatgctccggtgacttttgaccctatatcccccaaatcatgaaaggaaacggttccgcataacaaaacgagaatggcgcccagcgacgccggaacggcttcatttaatcccccgggtctccaaaatataaaaataatggtcacaaagaaagaaatcagggtcaaaatgacggtaatatgtgtaatgtgttctgcctccttttagatgggtcattgccgccccgttatttttatccctcctgatcagttgtactgtatgtatacgggtacaggtcgtaaggtgtactgagcgtttctaccaatttagtaaaattccataaaagcacaaaaaaaagaggctgctttcggcggccctcttttttatgcattttccttgtccgcctgcaataaagcctggcgcttattcataatatccagaaaatgtttcagaatcgggttttgattatccttgcggtaggcaatgacccattcggcagtgagctgcacctgattaatgccgcggtaggcgacttcgagattaaacagctttttagcagaagaaggcacgaaggttacgccgatgccggcactaaccaatccgatcaccatttgatactccgtcgcttcctgaacgattttcggtttgaagcccgcctgctcgcagtagtttacaaactctaggtataaagtcggccatgtttctttcgacagtgtgataatcggttcattttttaaatcctgaatgtcgattgtctgtttagcggtaagcgggtgctgcttcggcaaagccagaatgcacggactgctctgcaccttttccatatgtaacgcggaatgctgtaaaggcggatgaaggatgccgatatcaatgttccccttcagaagttcttcctgctgtctgaaagaagaaatttcacgcagatcaagcttgacggaggggaatttttcgcggaattcccgaatgatcggcggcagaaattcatatgtggccgagccgacaaaaccgacgacaaggcggccgagctctccccgcgccgttctctgcgccatttcaatcgctttgtctatttcttcgatcgcgtttctgctgtgttttaaaaaactttctccggcagctgaaagctctacaacccgtttcgtgcgctttaataaggtcacgccgacttccttctcaagctgtttgatctgctggctgagaggcggctgtgtcatatttaaccgaagcgcagctttgccgaaatgaagttcttcggcaacggcaataaagtattgaagatggcgaagctccatccttatccattcctttctctttgttaattattcgtgaaacatattaatcatacggcgaattgatattggaggtcaatttccaaagagtgtatagtgaataatatcacaaattacttaaaattttatatttaatatgcataataaggagtgagggtgttggcaaaagcaacaaatgaactaaaaacctctggaaaaaatcggggggcggagcttgttgttgattgcttagtggagcaaggtgtcacacatgtttttggcattccgggtgcaaaaattgatgcagtatttgatgcgttaaaagataaaggacctgaactggttttatgccgtcacgaacagaacgctgcatttatggctgcggctgtcggaagactgactggaaaaccaggcgtttgtctcgttacttcaggcccgggggcatccaacttggcgaccggcttgttaacggctaatacagaaggtgatccggtagtggcgctggcgggtaacgtaattcgcgcagaccggttaaaacggacacaccaatcattggacaatgcggcgctatttcagccgattacaaaatacagtgtagaagtacaggaaacagggaatataccagaagcggtaacaaacgccttcagggcagcgtcagcaggtcaggcaggcgcggcttttgtgagctttccgcaggatgttgtgaatgaaatcacaaatgtgaaaaacgtacgcagcgtgccggcgccgaaacaaggccctgcaccggaagaagcggtcagcgcggctatcgcgaaaatccagacggcgaaacttcccgttctgttagtcggcatgaaaggcggaagaccggaagcggtaaaacaaatccgcaaactgcttgccaaaacaaaactgcctttcgtagaaacgtaccaaggggccggcacattgtccagagagctggaagaccaatatttcggccggatcggactgttccgcaaccagccgggcgatcttctgcttgaacaggcggatgtcgtattaacgatcggttatgatccgattgaatacgatccgaagttctggaacgtaaacggtgaccgtgctattatccatcttgacgaaattcaggccgatatcgatcatgcctatcagccggaattagaattattaggcgatatccccgctacggttaaacaaattgaacacgacgctgtgacatttgatatgggcagccgtgaaaaagaagtgctgagcgaattaaaacagatgctctcagacagcgagaaggcgccaagcgaccataaatccgacagagtgcatcctctgcaaatcgtccaagaactgcgcaatgcaattgatgacgacgtaaccgtcacttgcgatatcggttctcacgcgatctggatgtcccgctacttccgcgcttatgagccgctgaaactgttgatcagcaacggcatgcagacattgggcgtagcgcttccttgggcgattgccgccacattggtgaatccgggtgaaaaagtcgtatccgtttcaggagacggaggattcctgttctctgcaatggaattggaaacggcagtccgcttaaaagcgccgatcgttcaccttgtatggaatgacagcacatatgatatggtcgcattccagcagatgaaaaaatataaccgtacatcatgcgtagatttcggaaacattgacatcgtaaaatatgcagaaagcttcggcgccaccggcttgcgcgttgagtcaccggaacagctggcagacgtgctgcaaaaaggcttgaacacagaaggccctgtcatcattgacattcctgtcgattacagtgacaatgtccatttatcaagcgacatgcttccgaagcaattcaaagaaaaaatgaaagcaaaagctctctagcactctgcgcaccatgacctgttttctaaaacagcccaatttaaaaggagtgaagggaatatgaaaaacgcaagcgacatccatatgatgagccgcggagaaaaaggctcacctgaggatcagatctatcaagtatccaccatgacatctctgctggacggagtatatgacggagattttgatatggctgacattccgaagttcggtgatttcggaatcggcacgttcaacaaactggacggcgaattaatcggatttgacggcgaattttaccgtctgcgcggcgacggaacggctacgcctgttaaaggcggagacctgtcaccattctgctcattcacatttttcacgccggacatgacgcatacgatcgacggcgaaatgacccgtgaagaattcgagcaggaaatcgccagccttctgcctagtaaaaacttattttatgcgatccgtttagacggcgtatttaaaaaggtgcagacaagaacggtagaacgccaggagaaaccgtacgttccgatgatcgaagcggtgaaaacacagcctgtgttcaactttgacgacattcagggtacaatcgccggcttctggacgccgggttacgcaaacggcatcgctgtttccggatatcacctgcacttcattgatgaaggacgcaattccgggggacacgtgtttgactatgtcattaaagattgtaaagtgaccatttctcaaaaaatgaatatgaacctcaagcttccgaatacggcggactttttcaacgcaaatttagataatccgaattttgcgaaggatatcgaaacaaccgaaggaagcccggaataaaataaaaaagaaagcctcatttttctcgggggctttctttttatttggctgaaccggcaaagattaggtaaaatacagtcaaaagggaaaggtgtggtagctgtgaaagtattggtattagcggttcatcctgacatggacaactcagcggtcaataaggcgtgggcagaagaattaaaaaatcatgatgacatcacggtccgtgagctttataaagaatatccggacgggaaaatagatggggaaaaggaacggcagctgtgtgaacagtatgaccggatcgtatttcaattcccgctgtactggtacagtgcgcctccgcttttaaaaacatggatggatcatgtgctggcgtatggctgggcttacggttccaaaggaaaggcgctgcacggcaaagaattgctgctggctgtttctgtaggtgccggagaggatgcatatcaggcaggcgggtccaaccatttttcactgagcgagctcttaaggccgtttcaggcaatggctaattttacgggaatgacctatttgccggctttcgcgatgtacggggttagcagcgccgatgctgcggctatccgtgataatgccaaacgcctggcggattacataaagaagccattttagagttgtatgcattcatcttcatccgacaatatttcctgagaaatatttcgaaccttagacgtttctgactgctcaagaaagaaaaaacggatttcgcgctgaatttgcgaaatccgttttgatattatgtcagtttttgcagatcttttgtgctgatatatcccgttgcgcccccgtaatcgacaagcgcccagccgaaatcaatgccgccgccggctgtctttttccatccgaggaaagaaacgctcgtgtttttggcaagggaagctttgaccgcttgtttgtctgtatatacttttgtttttgccgtcgtttttacggttgttgcttctttaacaatataatgagtagatacaaatcctgtttttccgtttttataatgtacttttgcccagtcagcgttctggaatgaaacgatctttaagctgtcgcctaaatgaagggtatcagctctcggactggctgctgatgcttttgttctgacgttcaatgcttccacggaaacgagataagagtcaagcgggtagctgtacagatcgtcaattttgaccgcttcttgcgcgtgtgtctcgggaagaggcgttattccggcagctgaagccgctgatattcccgttgcaagggtcagaatggatgccgctttggctgttttcttcatctgtatctctccttttacttcatcctttcacgttttaccggaagtctaaacatcggccggttatttttgcgtttgaagtttcaatggagcggaaatggtttttttgactttttctcctttgagcacctgctccgccgcttcggccgccagttttccgatcagctccggctgctgggcgaccgtggctgtcagcttcccgtttttaatggaagaaatcgcatctttatttccgtcgaaaccgacgaccaaaatgtgtttgcccgagctgttaatcgcttcgagcgcgccgagtgccatttcatcattatgggcgaacacggctttgatatccggatgtccctgtagaaggttttccataacggtcaatccttttgtacggtcaaaatccgccgcttgctttgttacgacatccagctttttgtcggcaatatgatgaaagcccgttccgcgttcccgtgtcgcggatgcgcccggcaccccttgcagttcagccactttggcgccttttccgagctgatcggcgaggtagtcagccgccatttctcctcctttgacattgtcagaggcgacaagcgtttcgactttgccgtgttcggctgaacgatcaagcgcaatgacgggaatgccgagggaatttgccgattcgacggctgttgaaatcgctgatgaatcggtcggattgaccagcagcgcatcgactccctgctggatcaaatcttctacgtcatttgactgtttagatgaatcattttgggcatcgacaataatgaccttcatcccccgttttttggcttcctttacaacgccttcttttaatgaaacgaagaacggattgttcaatgtagagacggagagcccgatagtgaattcttttttatgttttgtgtttgacggttttgcccattgaggcggttcaagtgaacaggcggacagcaaaaacagtgataatgccgcgatcgtgatgatggctttcttcataatggtcctcctactatgccgattttttgcggtccagcagcaccgcgattaaaatgacgattcctttgacgacgagctgataaaaagatgatacgccgagaaggttcaagccgttgttcagcgttccgataatcaaaaccccgatcagcgtaccgatgatgcgccctcgaccgccggacaggctcgttccgccgagaacgaccgctgcgatggcgtccagctcgtatgattccccggccgtcggctgtgcggaatttaagcgtgatgtcagaatcgctcctgccagcgccgataataaacctgtcagagaatagatcatgatcttgatgcggggcactttgattcccgatatcagcgccgctttctcattgccgccgatggcgtatgtccggcggccgaacggtgttttgtgcagaagaacccacagggccgcaaatgcaatcagcatcgtaatggcaggtacgggaatgccgagaaaataaccgcgcccgaataattgaaatgcgtaatttgaaccgagccccgtaatcggatttccgtccgtatagacgagggtcagtccgcgaaagacggtcattgtcgccaaagtggcgatgaacggcgccatttttccttttgtgattaataatccgtttatcatgccgagtacggcgccgatcacgcagccgatgatgacggctaagatcggatcgatgcctgagaccatcatacccgcgaccaatgcgctcgataaggcgaggatggctccgacagagagatcaatgcctcccgttaaaatgacaaacgtcattccgaatgcaatcagagcgttaatcgcaacctgccgaagaaggttgagaatattgaggggttcaagaaaactcgggtttaaaacggaaacgatcagcacaagaatcagtaagccgagaaacggaccgagtttttgcgtgaaggtatgaatggaaaatcgcttttgttcagttgatgtcattggttcagttttcattctgctgccctcccgtggcaagtgtcatgatgtgttcttgtgttgcgccggccgcattgatttctccgctgatgcgcccttcgtggacgacgatgattctgtcactcatgccgagaatttccggcagctcggaagacaccatgatgatggcgactccgcgatcggtcagttcattcattaatgaatagatttcccttttcgcgcctacgtcgacgcctcttgtcggttcatcaaggatgagaactttcgggccgattccgatccatttggcgatgacgactttttgctgatttcctcctgataaatgccgggcggcggtttccggagatgcggtcttaatggtcagacgcttgatgagcagctcaacgaactccgcctcgcgttttcggtcaatgatgcctttcggagagaagctggtcaggttcggcaatgaaatattttcacgaatggacgtatccagcagcagcccttcatctttgcggttctccgtaatcaggccgaggcccttgcggatggcatcgtacggaccccgaatgccggtttttcggccggaaatccagatctctccggaatcgagcctgtcaattccgaacagcgctctcatgatttctgtccgtccggcacccattaagccggaaacgccgaggatttctccggcgctcacatggaaactgatctgtgaaaagcttcctttttttgaggcgtttttcacttcgagcaccttatcgccgagtgacggcgtgcgagtcggataccgatcggtcagctcccgcccgaccatttttttgaccacttcatcaaaattagtgtctttaatatgcgccgtatcgacagtgaggccgtcccgcataatggtgatccggtcgcaaatcgaaaatatctcttccattcggtgcgaaatatagacaatggatacgccgtcccgctttaacgccgtcattacgtcaaacagtttgctgatttcccgttcggtcagcgccgcggtcggttcgtccataataatgacttcggcgtttgtcatcagcgctttggcaatctcaatcatctgctgctggccgacggaacattgtccggcttcccggttgagaggaagagagactcccagtttttcaagctgtgattttgctagcgctttcattttcttcgtttccaaaacgccgaacgccgtcgtcagctctttgccgataaaaaggttttcaagcaccgtcatgtccggccatatattcagttcctgatggataaaggcgattccgtgcttttcggcctcctttggattggagaagctcatatttgttccgtttatcgtaatgtttcccttatcgagccggtggagcccggtgagcagattcattaacgtcgattttcccgctccgttttctcccattaaagcgtggatttctcccggcagaagctcaaatgagacgccggagagcacttggtttttgccgaatgctttatgaatgtctgtcatgccgatgtgcatgctggatcccttctttctagaaaatcacacccgcctgcaggatgcagttggcgtatggtgtcatttcacccgttcggatgacggcttttgctttctgagtgagccgtttgaattcctcgtgggacatgtactcgatcgtctgcgctgagaaatggctttctatgaaacttgcattctcaggatttgcgtctttgatctcggaagcggctatcaccttttcgactgccatctccccggctaccaggctggtcacgtcccgaaaggcgggaacgcccgccgttaaggacaaatcaattttagggacgccgtcagggacggggagacccgcatcggcgatcgcgatgaggtctgtatgcccgagatcggctaatactttggcaatgtggctgtttaacattccgtgttttttcatgacagcagctcctcaacttcttttctggccggcatcccgccttgggcgccgaagtgctgcacggacagggaggcggcgcggttggcaaacaggagcgcttgctcgatgtcccgtccttccgcgagtgcgacggcaagtgccgcattaaaggtatcgccggctcccgtcgtgtcgaccgcttctgcagggaaagcgggaacaagccgttccttggtgccgtctgagtagcgtacgccttgttttccttcggtaatgaacagcttgccgggatagccggcaagcgcttcttctttcgtccggtcaggaaataaaatggatgcttcatgttcgttcggcgtaagatatgcggcatcctcaatcgtcgattgtttcagcggccgggccggcgcgggattcaggataaccggaatctgctgcgcgcggcagtagctacacacttcttcaacggtttcttcaggaatctcctgctggatcagcacgatatcaatgccgggaagttttgctagcgcacttttggcataatcgggggagatgtcatcgtttgcgccttttacgacgacgatgctgttgtctccttctgcgagcacaatatgagccgttccgctttttttatgtgtaaccgtttccatgtagtccgtattgacaccgtttgccttcaggttttcaataatcgcttttccgtagccgtcattgcctgcttttcctaccatatatacgtttgcgcccaggcgggaagcggctacggcctgatttgcgccttttcccccgggcacagtttgaaagtctgtgcccagtacggtttctccggctttcgggcgccgatcggatgtgacgaccagatccatagaacagcttccgataacacaaatttcactcatggtgatcatcctttctcgtcgtttgtcttcttatgtaagtcacgggcatttgaatggccgtctctttcggcggctctttctttatcaattgcagcagcaggtttgccgcttgttttcccatctcatatgcaggctggcggatggttgaaagaggcggaaacaaaagcctgctctgcggaatatcgtcgtatccgatgatctgaatctcctccggaacttttttgccgagccgcagcgcctcatggaggacggcagccgccgcaatgtcgttgctggcaatgactccgtcggtttccgggtatgctgcaaacaattcttctgctaaaatggcggcatccttgatggaaaatgaagcggcggagatgacattgaactgcgcgcccgctttttgcagcacatcaagtgcgccgttaaaacgttcctgagcggtcggaaggtgggctgggcctttgacaagcgtgatgcttgtgcttttgccgcgaagcatttcctcagccgcccgttttccgcctgcccgcccgtcactgaatacggatggggcgccttcttttgtccggtccagaaatacgaccgggtaaaggctgccgttgtattcgggaaggtcggggtaatgggtggccgccaaaataccggcaacttgattttgtttaaatgtttgcaggtagtcgagttctttttccaactcttcatcgctgttgccgatgatcagccggtatccttcccgctgcaacttgtcttcagccccgcgggcaagctgagggaaaaagggattcgtaatatccggaagcaaaagcccgaccagtctggattctcttttataaagagagcgggcaacttcattcggataataattcagcttctccatggcaagcatgaccttcgttcgtgtatcttcatgcacgtagccgttgtcattgaggacacgcgaaaccgtggcaacagagacgccggcagcgcctgcgacatctttaatcgttgccaacaaacactcctccttcatttatgtaaccgtttacataaaaagagtaacacgaataatttcggttggcaacaaaaaaagagaccggggtctcttttagttcacgatgccgatttgcgagatattcactttgatatcagggacgatctcgatggaaggatagacctcacgccaattgagccgcttgccccgctcataataatgggtttgatagttccggccgatgccgaggatatccgagttgtgctcctgaatatggctgatcaccgatctggcctgcccgttcagatttgctgaggcttgtttgttcatttggtcgattgccgtataagaattcagcttgtccttcggatattccaagacgcgtgcattcagtttcaaacggattttcacttttatatgctgcggatctgtatctataaatacaatctttcgcgtggcatccgtgatgccgagagaaagataattttcaatatccattttgtatttgtcccacagcttcagattaatattagccgatttattaaattgcccgcttaaaagggtcaggagggtcgaatcctgaccgagcacctcagtcactttccgctggccgctgaacagggcagaaccctctacctttatcgtctgtccgttaatcgataaataaggaagggcgaaatccttatcagccgtcagcatgcttgaacggatggattgcaaattttccatgctgatatttgattccgcattagcgcttgttaataaattcgttaagtacttgctgacgatcaatttctgccggacgagcagcttcagcacttcaatcgcctcgccgtcttttacaaccgccggatgagcgagaagcgggcttttcggatctctgtaaaagacatcgagataaggaaaaagcggtttttccgccattttctcaccgattaataagactctttgcttggacgtgtcaatgcgctgatcgacaagcttatccaattgaaaccgcgcttcacggatggtgtgcccggaagcgctgagcaccgtcgtaatgaatgagccgcccgtttcctgttccgcctgggacgactgaaccttccgataggtgatgccgattttatttttaccgtcatgatcaacatcaaggcttgcggtcagcacgagagaaatatctttcagcaaattttgatcccagcatcccgcaagtgtcaggcttgcgcacatgagactgataagaaccgcttttttaatgcgcatggcggacaccctttttgcgtacaaggacaatcaataccataaacaacggaaacaaatacacaaacactatatcggaaatgcggaaaaactgatcaagctgctgtatcgttttatccgtgcttgtggcccaaatagacagaaggaagacgagcagggccagcggataaacaaaccggctgtggtctttttgattgaacagcttggcgatgccggtgcttgccaagtaaaacacgttggccagtgttgaaaagacggtcacgaaccaaaacgtcaaaaagagcagatccgtccgttcgataattctgaatgaaacggtttttaacaggtacagcacaggctccgggatcatttttatttcttcggggctgattgtgacaaagcaagtaagggtgatatacaggtaataaaggataatcaagatgtttgaaatcgtcagtattttgtagcgctggctgacggtgcagttgataaggggcccgatcacgagcgccgcctgaaagccggtaatgctgacaagtgtttgctgcaccccggtaagcatgtcttttgcggttccgtgaaaaatcggcataatgtatgtgatatcggcttttcccagcgtgtataaaatcggcagagagatcagcagcaaaaacggcgttaagataaagctgaacctggcgatcgcattcagcggggcttgggcgatatagacagaaccgaggatcagcattaagctgaccacccaattcggagtctgcgggagcacccagatatccaatatccgtgtaaatacagaaagaatgagcgtgcagagaaacgcgaaatataaaatatacagcacctgcacccctttgccggcaagtgttccgaatacctcctccagcatttcgtacaggttcagcttcggaaaccggtgaaataatatcatatacaggctgaatgtaagctggacgagcaatccggtaagcagaatggaaatccatccgctgcttcccgatttcatcatcagtaaatggggcagcgccaaaatgccgatgctgatctgcgtctgattgatgaaaaacacgccttgaagcgggctgatttttttaggcttcatcttttctccacccccgaacatgttttatctgctttgagtcttgcggtctcaaataaaaaggccttcttttaataaaccaagccggcagccggataaatgcatccttcaagtcgctgaaatgaaacggcgtcagagatgataagtaagggacgccgagtgattcaagcttgcacaggttcatcagaataagcccgaagccgagtgcgatgccgaaaaaaccgaacgaagatgccagaaacataagcggaaatctgagcgttcggatggacgtgctcatttcatatgaaggaagcacaaaagaagaaacggccgtaacggctacgacgatgatcatcatattagaaatgagtcccgcctgaacgactgcgtcaccgatcacgagaccgccgacaatgccgatcgtctgactgatcggtttcggcagcctgataccggcttcgcggatcagttcaatcgtaatctccataatcatggcttctatcagcggagggaagggaatatcaacaatcgaatttttcatggtgataatcagatcgttgggaatgacttcaaaatgaaatgcaatcagcgcgatataaaaagcgggcagcgtaatcgcgatcataaaggcgaaaaatctcagcactcttaaaaaactggcggaaatccatctcgtgctgtagtcatccggcgattgaaaaaaagaaaagaatgtgatcggcgcaatcaaagccgacgggctcccatccatcatgatcagcacacagccttccatcacgcatgcttttgctttatccggccgttccgtatgaatgatctgcggaaaaatggaaaacgaattatcttctattgattcctcgataatcccgggcgcaagcacgctgtctatacgcaagtatgacaggcgccgcttcacttcctccacaatctccggattggcgatattctcaacaaagataaccgcaacctttgatttggctctttccccgatatccatataatgaacggagagatggcggtcctgtatgtgaaaccgcagctgatgaatgttcgtttccaaactttccacaaacccgtcatgggcgccgcggacgatactttcagattctggttccataatggaacgcagcggattctggccgacggaaaacagcttcgctttcctcgatgcatcgctgagaaaaacaacctggcctgccaaaatcccgtcaatgagttttctggtttcatccgtttccgcactgctgacggcattcatcgtttcctcaagcgggccgttctgcagggtgtcgcttaacagaaactcattcagcttctgttcttctatcatctgttcaatataaaagaaagcggtatgacggttctgcagtttgatccttcgtattttaaaatcaccgcaaacacacatcagctcctgcatttcccgtacagccgattcaaaatcgccgggaatccgtttgttttgtttatccgcagacatcagaccgcctcctttcccggttatctgtagttttcagcgggtattccttttttatgcattttataaaatagaggagttcctcgatggttttaccaagaacttcacaattatggatgaatatttcttgaacgaatataaagatttattaaaaatatttcaaaagagtgataaacgtcctgtaaatggtttaaaaggagaaaggctttccgcatataaaatgtgtatttcttgtaaacactccggacccgtctttttctgtcatgtaccagtcattccgctagttattttggaatgggactgaaagcaggatacgggggaaaaatgaatgactttaagaccttatccttaacaaaacaggcagtctgcacacagcggacagagagtcccgaaacgtatgcgcagtgcgaaaaacgctgatacaaacgggctggaaaagatggattatcattacatctttttcttccggaacgcgaatagttccattggtccaaatgaatttctgtgcggaaatgtaaacgcattcatttttcttttgaaaaattgaagtaaggttgaagtcctgcctattcccaaaaaaagcaattcaataataggaagaatagcgtcactaatagagaagtttggctcagtgaaagcgggaagattatgttacataatgccgattgagaattcatagtgaagctatatactgatgaatgaatttatcaatacagaaggagatgtcaaaaatcaatgtggttactcattatagcctgtgctgccgtactaatcatcggaatcattgaaaaaaggcggcatcagaagaatatcgatgctctgccagtacgcgtcaatattaatggtatccgcggaaagtcaaccgtaacgaggctgacgaccggaatactgatggaggcgggctacaaaacagtcggaaaaacgacgggaacagatgcaaggatgatctattgggatacacctgaggagaaaccgatcaaacggaaaccgcagggcccgaatatcggcgagcaaaaagaagtaatgaaggaaaccgtagaacggggcgccaatgccattgtcagtgaatgtatggcggtaaacccggattatcagattatctttcaggaagaactccttcaagccaacatcggcgtcatcgtgaatgtgcttgaagaccatatggacgtcatggggccgacgcttgatgaaatcgctgaagcttttaccgcgacgataccgtataacggtcaccttgtcattacagacagtgaatacacagacttctttaaagaaaaagccgcagagcggaataccgaggtcattattgcggataactctaaaattacagatgaataccttcgtaaatttgaatatatggtctttcctgataacgcttcccttgcgctcggcgttgcccaggctcttgggatagatgaagaaacggcgtttaaaggaatgctgaacgcgccgcctgatcctggcgccatgagaatcctgccgctgctcagcacgaaggagcccggtcatttcgtaaacggctttgccgcaaatgatgcatcttctactttgaatatatggaaacgtgtaaaggaaatcggctacccgacagatgaaccgatcgtcatcatgaactgccgcgccgaccgtgtggacagaacgattcagttcgcaaacgacgtgcttccgtacattaaaacgaaggaactcatactcatcggcgagacgacggaaccgatcgtcagagcttatgaagaaggcaagattcctgccgatacattgcacgatctggaatataaatcaacagacgaaatcatggacgtgctgaaaacaagaatgcaaaaccgtgtcatatatggcgtcggcaatatccacggttcagcggaaccattaattgaaaaaattcaagagtataaggtgaaacagctcgttagctaggaggaaaaggataaatgttcggatcagatttatacatctcacttattttaggcgtgttaatcagtttaattttcgcggaaaaaacaggtatcgtacctgccggtttagtcgtgccgggttatttagggctcgtttttaaccagccggtctttattttactcgtattgttagtgagtcttcttacatacgtgatcgtcaaatacggtttatccagatttatgattttgtacggacgcagaaagttcgcagctatgctgataacgggaatctgcttaaaaatcgcccttgatttcctttacccgatcgtaccgtttgagatatcagaattccgcggaatcggtatcatcgtaccgggtctgatcgccaataccattcagaaacagggattaacgattacatttgccagcacgctgttcttaagcggcgcaacttttgccattatgtttgcttactacttaatctaatgtaaggtgtgtcaaacgatgaaaaaacaattaagctttcaagaaaaactgctgaagctgaccaaacagcagaaaaagaagaccaatcttcacgtttttatcgcgctgccgatcgtcttttgcctgatgttcgtctgcatcctgacagggaaggcggaaacgccgagtgtgaaaagaaatgccgatgaccttgtatcagcctcattcgtcggagatattatgatgggccggaatgtcgagaaagtgacaaagcataaaggcacggagagtgtcttccgttacgcaaagccattcttcgaagcatccgactatgtgtcggggaactttgaaaacccggttacatataaaaagaactacaaagaagcagaaaaaaatatccaccttcagtcaaacaaagatgccgtaaaagtattgaaggacatgaatttcaccgttctcacggcagccaacaaccatgcgatggattacggccctcaaggaatgcgggatacggttgaagagttttcaaagcaaaatcttgaacttgtcggcgcgggcctcacgctgaaggaagccgagcagaacatttcgtatcaagatgtaaacggaatcaaaatcgcaacactgggtttcaccgatgtttccggaaaaggctttgcagcgaaacgaaatgcgccgggtgtgcttccggccgatccagagctgtttattccgatgatttctaaagccaaaaagaaagccgatcttgtcattgttcaaacacactggggacaggaatacgataatgatccgaatgacagacagcgccaattggcaagagcaatgtcagatgccggagcggatattatcgtcggacaccatccgcacgtgctggaaccgatcgaaatgtaccacggcaccgttattttctacagcctgggcaacttcgtattcgaccaggggtggacaagaacgagagacacggcgcttgttcaatatcatctgcagaaaaacggcacgggacgctttgaagtcacgccgatgaatattcatgaagcaacgcctgcaccggttaaaaaaggcagcatcaatcataaaacgatcgtacgtgaactgacgaaagaatcgaatttcaagtggagcgtcaaggatggaaaattaacgtttgatgtggatcacagcgatatcttaaaaaagaaagcggagtgaaaaacaaatgaaaatcattaaagcaggatggccgtttgccgcgatcattatggtctttatgtttatgtcagcgtttaaatacaatgatcagctcacagatcaggaaaaacaaaaaattgacacggaaatgcaaaaaattcagcaagaggacacagcgggcgcaaaataagcgcatgattccgcttgccggcatattgtttgttccgaatccagtaaagaatgcccatatcgggcattcttttttgtgtactctcctaaacatttgttaaaagttaccgatgtaaaaactaccaaaaataaggagagtgaatagaaaacatgctcacaagctggaggaagtacatccttgccggccttatgatttgtcttgtggcacccgcagtgacgagaacggaaattgctgaagcggattctcaagtttctgtcctgatggtttcagacgcgcaaaaacttgtcggaaataaatatgtttacggaggcgaagagcctgaggacggttttgatccgtccggattgatgcattatcttttcagcagacagaacatccatctgccgagaacggtcagtgatcaatggaagattggaaccgccgtcaaagaaaatgaccttttaccgggagatcttgtgtttttcaaaaagtcggattcaacacaaaacgcgcccgtccatgacggtctttatatcggaaacggagagatgatacacagttctccgtctgaaggcgtaaccgtcacacgctttcaaaaaagcagttattggatgaatttatatcttggcgcaaagcggattacaaaagatccggaactggctgatgatccgatcgttcaggaggcagccctttacctcgacattccgtatgtattcggcggaagcacgcccgaggagggattcgactgttcggggctggttcaatatgtttttgaaaacaagcttcacatttacctgccgagatctgcggaacagcagtggctggtcggtgagaaaatcaaactgagcggcataaagcccggggacgtgatttatttcagcgacacgtataaaaaaggaatttcccatgcgggcatttatgcgggagagggaaggttcatccaagcaagccgctccgcaaaagtcaccatttcttacttgtcggaagattattggaaaaaacattttacgggggtgcgccgattcagcaatttagccatttctaaagaaaatcccgttgtgtccacagcggccgatcatatcggaatttcttatctgaaaggcggcgtttcaccggaaaccggctttgatacggcgggatttgttcaatacatctatcaaaaagtgaaaggaatcagcctgccgcgttatgcggacaagcagatgcaggcgggcgttccggtcgataaacaagatctgaagcccggcgatctggtcttctttaaagcggaaagcctgaatccggccatttatatcgggaacggacaagtgattcatgtcaccgtgtccgcaggcgttaccataacaaatatgaacacaagcgcttattggaaggacaaatatgcgggcagcatccggctcccgtaaaaaaaagacgtcagagagtgtctctgacgtctttttcttttaccgtttcggcgctctgtatccggccgctaccgcatcctctacggaacagaacatttccgcgggatctgtcgtccggtcgtagtatgtacttcccggtgtgtgataaatgccgttccggctgcctttaatgtcgcatccctgtgaggtgccggctgctttcgtttcggcatgtccgccggaggaaggggcgttgttttgcgccgtttccgcattttcggatatttttgtttctgctttctgccgctttaaagttttattttctgactgaagcgtttcagcggtcttttcgagcttcttttgtgaattttttaatttctcattgtcttgtttgagtgatttgtttgtttttttcagcttgcttatctcttggctgagtttgctgagtttttcttcattgccggcttcggcttcggatttctccttttcggccgcggcactgatgttttcatattttttctcaagcgcctggtgttccttcgtcaatttttgataagcggtatcaagggtgctgtatttctcctctgccttcacggccgaggcgtccggctctgcgagggaggcgccggtcagaagcaggataaatccgccgatgagaaggggccaaaacagcttttttgaaaaatgtttgtctttttttgccgctttgcatatgagatggaatattccgtatccgactgcgcagagaaaagctaaacatcctataatagcgattgcattcgacatcatgaaactccttttttctttatcttacaatttattttcatttttgggaattccttttttgggaaacatgaaaaaccaggccgtgaaagacctggcttttgccttttattgctcgttgtcgagaagccggttgatgaaatatgcgacgccgttttcatcgttgctttttgtaatatacgtgcttttttccttcagttcatcaatcgcattgcccatggcgatgcggtttcccgccgcttcaaacatggagaaatcattcgggctgtcgccgatggcgtaaatatcctgtttttcaattccgtacagtgaggcaagctccgtcagagcacgtccctttccggaaccggcagggaggatttcgataatgtgttttccggaagatgtctgggataatttcggatgatgtgtaatttcttctttggcgtttctcagtttttccatatcaaaagagaaacaaagaagcttgtaaacatgttcgtctccgttaaaaatcgcctgtatatcctgcacgggtttaatgccgaattgtttgaactgcgtctttgcgccctcccataatgtccgaatatcttccttgggattggcgcttttcagaatgtccagttctgcctgcagtttggactcgccgtcaaacggggacagcagatgatcatctgtatagacctcaaagtaaatgttgttgtccgttaaataagcggcgatatccttcccggcctgctgatccattaagagccggctgacgaggcggtatcctttgtcatggactgtcccgccgtttgccgcaatgatcggaatatccaaatcctttaagagcgcttttacatcaaatgtggctctgcccgtgcagatggccacgagaatgcccgcttcatccgctctttgtaaagccgctctgttttccggagaaatcacactgtccgagttcagtaatgtgccgtctaagtcaatggctatcaatttcatatgtatggatgccctccttaaaaataaagctgcttcatgtagtatgttcagctttgtgcgaaatcagcagaaagccgtcagttaaaaggctataccttcatgtcctttttttcaacagaaaaacggcgggatttgctaaccccgccgtgacatcttacgcgtttaaatcattttttaatttcgttttcacttcttgaaggttttcctcattcagcttgaagtaataaatatttttgccgtactgaggagtgtaaatatagctgtctgaacctgtcagctgcaaagaatccaccgatttcagcgatgtgataaacgggaacagaccgatggcgtcattaagagataagttcatttttaagtttttccctaagctgtcgacgatatcgtcataagatgggatcgagcttaacgatttagattttttaataatggcgctcagcacttccatctgtctttgtccgcgcatcagatcggtgtcggctttgcgtgttcttacataagccagtgcctgctcaccgtcaagcgtctggacgcccggcttcagcacgacttttccttttgtatcgaccttaatacgatcggcaattttctggcttttcacatttaccgtaacgccgttcaactcattgacgacatcgcggaacgcgtcgaagttgctctcaaccacataatctaccggaatatcaagcatgttttctactgttttataagttaaattataaccgccgtaagcatgtgcgtgtgcgaatttgtcatagccgtgtcccgggatgttgacataggaatcccgcggaatgctgagcatcgtcgctgttttctttttccggttgaaggtgacgagcacgttggcgtcacttcttgcgtcatctactgattcacccttactgtcacgggcgtctattcctaaaagcaatacggtgaaagaatccttcttcgggtcaaattctttgatccgttttacggactggtcgccgcggtcaaggctgacgtgcgcttctttggtcgcattattcaatttcacaaatgcgtaggtgccgacggaaccggcgatcaccaataagaaagcggcgaataccagtacaaatttcacccattttctgaggcgtcttttcttttttctgcgttgagatcgttcttccatatcattacctctcgtttctattctttgtgaagcgtaccataattgttgacttggagcaactcttcaaatgagaaaattccaaatctttctctctatttcgacaacatctactgttatttttgcattaggttcacattatattggacggcaggaagcgggaaatgtttcggcgctttgtaaaaaataatcagtaaaataatggatattaacggtgcggaaggtttgaaacgatcggaaacaggcaaaagaagcagtagaacaattccgcgcggatacagcgttggatgaagggagtctatataacatgaaaagcatacactcgaataaatggctctattttttcggcgcactcggcggcgcgttatacggatatgataccggagtcatttccggagctattttatttatgaaaaaagaactgggactgaacgcctttacagaaggcctcgtcgtcagttcgttattggcgggggcgattctcggatcgggattcgccggcaaactgaccgaccggttcggcaggcggaaggccatcatgggagcggcgctgctgttttgtataggcggtttaggagtcgcttttgccccgaatacagaggtgatggttcttttccggatcattctcggactggctgtcggaacatctacaacgatcgttccgctctatttatcggagctggctccgaagcataaacggggggcgctttcttcgctgaatcagctgatgattacggtcggaatcctcgtttcttatatcgtgaactatatatttgccgatgcaggcgcttggcgctggatgcttggacttgcggttgtgccgtcagtcattctgctgatcggaatcttatttatgccggaaagcccgcgctggctgtttacgatcggcaaagaagagaaagcaagagaaatcctttcattattgcggggaacgaagaatattgatgatgagattgatcagatgaaagaagcggaaaaggaaaacgaaggcggcttgaaagaattgtttgagccgtgggtgagacccgcgctgattgccggcctcggacttgcctttttgcagcaattcatcgggacaaatacaattatttattacgccccgaaaacatttaccagtgtcgggttcggcaattccgcgtctatattgggaacggtcggaatcggcgccgtcaatgtcatcatgacgcttgcggctattaaagtcattgataagatcggccggaagccgctgctgctggccggaaatgcgggcatggtcatcagtctgctcgtattggccgcggtcaatcttttctttgaacattcagcagccgcatcatggacaacggtgatttgtttaggcctgtttatcattgtgtttgcggtcagctgggggcctgccgtatgggtcatgcttcctgaattattcccgctgcatgtccggggtatcgggacgggtgtctccactttgatgctgcatgccggaacattgattgtctcattaacctatccgatgttaatggaagcagtcggcatcagctatttatttctcatttatgccgcgatcgggatactggcattcctgttcgtccggtttaaagtgaccgagacgaaggggaaaagccttgaagaaattgagcaggatctgaaaagccgtaacggaggctcgggatcagaatcaaatcggcggacagttcatccgtaatattcagttttaggggggcggttattcaccggcccctcaaaacggatgccgagcgggcgcccggtcacataaatgacggggatatgtcatacgttgtataaagtcacgataaaggcggggatgccggtgaaaacgagtattattatccttacatataatgaacttgagctgacgaaaaaatgtctggccagcattgaacgatacaccgacaaagataagattgaactgattatagttgacaacggttcctcagacggaacgagagaatacatatcaaatctgcctgacgtcaaagtcatcctaaatgaaaaaaacctcgggttcgccaaagggtgcaaccagggtatcgaagcggcagggggagaaaatctgctgtttctgaacaacgatacgatggtcacgaaaaattggctcacctccatgctgagggtgctgtatcattctgaaaaagccggtatggtcgggcccgtcagcaactatgtcagcggcgcgcaaatgatccatgacgcatatcaatcgcttgatgagctggaatcattcgcggaggcgtattgcgcacgggaaaagcatcatacaaagcgggtgctgcgccttgtcggcttctgtcttctggtgaaaaaaagcgtcattgaagacaccggcccgtttgatgagcaattcggatacggttcttttgaagatgatgacctatgtctgcgcgccctgcaaaaaggatacagcctgcacatcgctctcgatgcctttgtgcatcaccacgggcatgcgacgtttacggctaatcaggatatcaatatcaatcagttatattcggagaaccgccagcgttttacggaaaaatggggcactgattttacgtactttactcatccgagaccggaaattgcggagctcgttccccgggaggcgaaacggatacttgatgtcggctgtggtgcgggagctacggggctggaacttcaaaacagacagccttgcgaactgtacggaatagaactgcacccgctggcggcgcaagcggcaaaaggacattatgaagcggtgctgcaggaagatgtcgaaaaagtgaagctgccttatccggaaggcttttttgattgcatcattttcgcggacatccttgagcacttaaaagacccgtggcgcgtcattgaaacgtactcatcctatttgtcgcctgccggatcaatcgtttgcagcattccgaatatttcccacgccgaagcgctgttcccgcttctgctcggtgactggacatacagagacgccggtattctcgaccgcacccacttgcggttttttacgccgcagacggtgcgcacgctctttccggaagagacatttgacgtgaaaaagcagtcctatacgtatgttcacgtggatgagcgggtgcagctgtttttacaggaaatcacacgaatggcgcaatcgatgcaatttccggtgacacagctgcccgaacaaagccggatttatcagattctccttcgtgtcgaaaaaacacgctgaaggctaccgccccatcgttccgaagttggtaatctgaatggaaacatcatagtcaaaggccgcttcggagaaggtttcatcccagtgatgcttcactttcttccaatagtcgggatattgaatgcggactctgtcagaaaagaagacagggtccgtttcatattgattctgcagcttatcgatgacttctttcatatcgcttttcagttttttttcgaaaatcttttccagcccgtttaaatagtgctgatcgaatgaatcttctccggcatattgatcctctgacaaaagtccttttgttttcaccgctacgtgaaatgacagcttcccgtttttcagcaggggggtgatggaggatgttgattttttgatctcgaaggtaatcgggtgccctcctttatccaaagcgggcagcacgccgccctgtatcgtccccgtcagccaattcaggctttgtacttcgtatgatgacagaaagcctgccaatctgttttgttttccgtttttgataatggccgctccgtcatacaccgtttttcctttttgattgctgacggcctgaatgagaaaactgagtttattatggcagtaaatcgaagctctcccgattcggagcggttttaaaatcttcccgttgtagccgccgttgttcgtaaggtcgatcagcttttccgcgggcatgggctgctgctgattcggcgtcggctctgtcagaatatcggacgctttgcctctcgccgcgaagagatagctgctccgccttaattcatcatcacggataaaatgattcatcatctggagtatattttggtcggccagcaatttgtcgctgaatatcagcacttttaaatgatcgctgtaaacgggcggatcttttaaagcgacttcactgacggcttcaagaatggtatccccccgcgacgtcacattgacaaacacgggccggccggaagcctggctgttttcactttggggcagcaggttttgataggttaatttatatcggcggtcactcgtctcgtctatcgccagtccccgggcgaaagatagcttttcgacttccttcgcgtcccagcaccctgaaagcgtcatcagtatgaaaagcgccgccgcccatttgatgaaaagtgtcatgacgtctgtttcctcccggctatttttttcatccagctgacaaaccagatgagaaaaggaatcataatgacggcaaaaaacgcatatccgagaatattcgcgaatgcaaacacactgttgatatcatcggggtacattgaaaggccgaatgtcactgccaataagccccccagcagccaggcattgtttttatttttcagtctgaaaatggtgtttaacccgagatgcgctcctttaaaagaaccgagcatacaggtgaactgctggcatgtccacgtaattaaaagaaagatatcaaacctttcgatgaaaataccgcggatttccaaggcgtgaatcagggaaatggtcggatatgtcaccgttttggcttcagcgatcgacatacagccgatgacgacaagcagcgtaaagctgtaaaataagcctgcgcatgcgatgccgaagacggcagcctttttcgcctgcttcggatttttcataaacggcaccagataaagaatcacctcaagtcctgaaaaatacagaagggtccgcggaaacagctcaaaaaagcttttgtagcccccatccaagaccgggcggacgaaatccagcttaaacagtctcaggctgaatatgagcagcacaatcagaatgacgatcgcaatcggaaagagataagcatagagttttgaaatgggatacaccccgccggtcacatggtagatgccgaccgccagaaagatgaatataacgacacccatcggcgtatttttcagtaaaaagtaattgatgacctcaccgagaaaacgggcttgaaaacagacggtgacgacaaaataacagctgatgaataaattcagaagagaaccgatggcgcgtcccatgatgctttgattcagctcataaatggtttccccgctgtttttctgcaaaaacggcataaagagcaggacgatgccgataaacacgagactctgcacaagaataatgatccatccgctcggactgtccgctgctgcggcggagcgcggcagtgttaacacgcccgctccgatcattgttccgcttaccatgagaagtgtctgcataaacgacagcttgtcttccggttttttcatggtgatcacctttgcttgattttatctttcgtctcttttctggtcggccgttttttcaaaagaggcgtcggcagtctgacgatcgtatcttttaagtcctgtcccggctgcgccatgatcggaataagatagtcctggccgaagcttttcaggcgcatcagatggccgacgacaagcagataacacatgatcagtccgtataaacctaatatcgccgacaaaatcatcgaaaaaatacggatgagtctcagcggaaaattgaacgcataggagggcgccgtaaaagaagccaatgccgtaacggatacgataatgaccatcatcgcgctgacgatgttcgcctgaacggcggcctgcccgatcaccacgcccccgatcaggccgatcgtctgtccgatcggcttcggcagcctgagtccggcttctctgatcatctcaatcgtaaaaatcataataaacgcttcaacaaaagggggaaacggaacattcaatctgcttccggcaatcgtcaccgccattctcgtcggcaaaagccccgtgtgaaacgtaacgagcgatatgtaaaggccgggtaaataaatcgtgattaaaatgcatgtataccgaagcagcctgagaaaggtaaccggaacccaccgctgattataatcgtcaggtgagtggataaattcatcaatggtagccggcaccaaaagggtaaaaggcgttccgtctacaagaatggagacccttccttccaaaagagcgcccataacccggtcgggccgtttggtcgtcaagacggtcgggaaaatggaatacgtgttatcttcaataagctgctcgatcgttcctgattccggaatgtcatcaatggtgatcgaatccagtcttttcatcacttcttttacaacatcatcaggcgcaatatcccgaatgtaggcaacggcgatccgcttttttgtccgttcgccgagtgtgatctctttgatctggaggttgggatcaccggactgctcgcgcaaaagcgccgtattcgttcggagcttttcgacaaaacctatcctcggcccccgttcaagcacttctgaagccggttcttcaatatcacgcattttaaatgtttccgtttcaaacgaaagggcttcctcccatccctccgccagcaaaaccgatttgccggaaaaaatgtctgcctccgcgtccttaagtgaagaaagccgggtgtgacgatagccgaaagagatggatgacggcggtatttcagccggttcctcttgatgcagggcggccgcctgcacgggcgaaataatatattccgcaagcaattgattgtcggtcagtccgtctatatatataaggcaggcgtcacatttgccgtttccgtacgtaaacgaataaaacatcatgtcatcgctttggccgaaccgttttttcagcgcttcaaggtttttgccgagctccgcatgtatcgtcataatgttcccccctttccatcagttattttaatttgcgacaaacaaggcattttattctggaataggaaatgactgagcattccgccccatccgaatggtataatgagcaggtcagccattttatacatattgtttttaaccgcggctccctccgtgttttaaaaaagacacagggggaatgggatatgagccgctttttaaggggaggggaacgaacatgacgcaagagccgatttttttacagcctgtatgtaaagaaaaaatatggggcggcacgttattacgcgaacgattcggatacgacataccttcagaaacaaccggcgaatgctgggcgatatcagcccatccgcacggaatgagcacggtcaaaagcggtccgtatcaagggaaaaccttgatggaactgtgggatcagcatagagaattattcggcggaacggaaggggaccggtttccgctgctgacgaaaatactggacgtcaaacaccatcagtctgttaaagtccatcctgacgattatgacgccgaggagcatggacagggtgaaatggggaagtctgagtgctggtacattattgactgtaaagaaaacgcggaaatcatatacggtcacacggcccgttcgaaagcggaacttgtcaccatgattaacagcggtgactgggaaggcctgctgcgccgcgtgaagatcaaacccggcgatttttattatgtgccgagcggaaccatccatgccatttgcgcgggggcgctcgtgcttgaaacacagcagaattcagaggccgcctaccggatatatgattacgggcgtacagatcagaacggcgggacgcgtgatctgcatatccgcgatgccgtcaacgccgcgaccgttcctcatgtggacggatttttagatgaatcaactgaaacgagaaaaggcgtcaccatcaaaacctttgtgcagggagaatatttttctgtatacaaatgggatatcagcgggacggcggaaatgacccaggatgctccgtttatgctgtgcagcgtcacagaaggaagcggctccatcatctgtggaggcaagtccgccgagcttaaaaaaggcgcgcatttcatactgccggatcagatgcctgactttacgataaacggagattgcacgctcatcgtttctcatatataaaaccaaacttaatcccagctctgggattaagtttttttatatatatatttcactttaaaaattaaagcactttccgataaaaataatagtgtgatagataaatatagagaaggaggagaagtaatgaaaaaaagtttggctgccgcaatgttattgtcagcggttactcttgaatttttcacgataacagactcagtaaaggcagcttatattgacaattccatttatcagttagaaacaacacaaaagtttgcttctgaaagtgaggcttctcaggcagttacaaaattgaaaaaagataccggatggaaagcagactatcaaaagagcggaacgtctaagaactatcaaatatctgcttcaggtctgacaagcgaaacgaatgctaaaagcgtactaagcgattttacgaagcagacaggcattaaaggaacatcaagtccgacgggcagtaagcagccctattatactgcagtttccggaactatttcaggtgaacagcaggctaataacttgcttgataaaatgaaaaaggaaacaggattaaccggtactgttaaaccgaatggtgtgaagcagccttatataagcattgttacatctgagctgacaagtgaggccggtgcaaagtctgctattcaagagttaaagaagcagactggagtcaatgctaattatcaaaaacttgaacaggaaccggagatcattcaaattcaatccggaaaaattcaaggagagaaaacagcatcccaagtgaaaagcagttttcaaaaagattctgggctgaatgccacgttaaacatgactgataaaggccagtcttactacattgttacaacgaattctttgatcaataaagcagatgaggcgaaaagtcttatcaaacagcttgaacaaagcacaggcgtcaaaagcagttacaaaaccatcaataataaaaaaactatcacatcgtataatatagaaacgggttattttaacgggctgagcatggttaaaaattcgatcagccaaataataaataacacaggagttaaagggtcctaccaaaaagttggtgctacaagtaattatgttgtgaaaatgaaggatgtcagcccggaaaaactaaaaagtcttcaagctttttttaagaagaaaagatggcatatgacttatacagctgtaaagaaaacttcaacccaaacaacttatcaagtgataacaaatgctgtaacaaacgcacaggcggataaagcagtaaattttcttagcagaaaaaaattaaaatcatcaaaatcaaattcaggaaaaacagctgctaatcaatatcaactgttatcacaacagactgctgacaaaacaaaagtaacaaaaggtttaaactctttaaagaaaatcggtattaatgcaactgccaaatctataaaacaaccaaaaggaataacttataaaattaagacagaagccttgctggacacagctaagattaatcaagtcaaatctttcttcaagacaaaaaaattaacggcagtaagtgaaaaaaccggtaaatccgcttatacgcaatatcaagtcactgttagtgacttattaaatcaaaaagatatagatcgtgtgttaactttttttaaaacaaataatgcgaaaggcaatgccaaacaaaatggcaaaagcacatacacgcaatataaattagttacagatcaaatcagcacatcgtcggctttaaacaaaggactgagtttctttaaggcaaagaacttatcagcaagctacactactaaaaacaatccaatatacagtatagtgattactgaacaatttacaggaaaaagcaatgctgataaggctgcaagcaaagtgaagcagctttatgggtgggcagtttcaagtgttgaggtgaaaagcggtcctcaaataatggaaacaaattataatattacgatgagtgaaatggtcgcgaagcagttaaaagcgaacccgcagacggattcaagtgcctacgtatctctatcttatattaatagtgcaaattctaccgtaaccgcagattttcttaatgtcaggtctactccagaggtaaagagcaataatattataggaacagtgacaaaaggttataaggttaatatcattagtgtagagaataactgggcaaaaattaaaatgggttggcggaaagcaagcgaggaagaagtttcctactatgtaaaccccgcaaacttttctgtgtcagataaaagttattttcagtttttgaagttatcgaaatatgcaggactgacagcatcagaagtcaatacaaagattttaaaagggaaaggaattcttgaaggaaaaggtgaagcttttattaaggcagctgaatctaacagtattaatgagctctacctgatttctcacgctttattagagaccggaaacggtacctcagagctggcaaacggtgtgacctataatgggaaaaaggtatataacatgtatggcataggtgcatatgacggagacgctgtgaacaagggtgcccaatatgcatataaccaaggatggttcagtcctgaagcagcgattactggaggggccaaatttatcggacagagttatatacacaatgccgtatacaaccaagataccttgtataaaatgagatgggagccttctgtaagccaccaatatgcatctgatattggttgggcgtataagcaggtaaatagaatgtacagtctctatagtctgttagataactatcagctttactatgatattcctgtctataaataaacgtgttaaagagctcggagtcatacttccgagcttttttcaatattaaattggacagatgtctttttgtttgtacgattatttttaagcactatggaggcaatataaatatataaaacacctgttcaattgtgtgaacaggtgtttttgtatgttatttgttcttctgcaaattggagcagtttgctgctcgaattcccatctgaatacatattccatttgtccgagaaccgcttcatttcttctgcacgaaatggctttttcgtcatttcctccagaagggcttcgctgtcatgacaagcctttccgggaatgacggacgtataattgtcgattaaaccgcgttttcgatcatattcctccagatcatacgtgaaaaagaaaatcggtttatttaagagcgcgaattcaaaaggcacggaagagtaatccgtaattaaaatatcagccgctttcaagagatcatgaagacgcatgtcagacacgttcttgatcagttcgctttcaaacgaagccgaaatatgatgcaaaacggcaggatgaagctttacaagcagcatatactctccgtttaacgcgtttgtgagctgttcttcggtgaatggcagccgaaaggattgcatatcataatccctgaatgtcggtgcgtacaagatgatttttttcggccatttgtgcttcagttccggcttgtgttcttcataatagacgtcagtcagggggatacccgtttttaacagctggccgtcccgtatgccgaacgactttttaaaaacgtcagccatggcgtctgaaccgacggtaacaaagtcaaacgagcggtacacttttttaaaacggctgatatctgatgccggacgattttgattcgtcacatcctcaaggccgaactttttcaaagagccgttcgcatgccacacctgaatgcatgtcgtttgcggccggcggtttaagacgcttgtcatgaggaaatagttatccgttatcaccactttgcttttaaaaaggaccaaaacagccttcaaaagatgcagcggatgtttttcgttcagataaaaagagccgacaccttccagctcttttttcagactgacggcgtgtctcgtatacaaaaccgtcatttcataagaaagcgattcagcgtgcgctttgtaagaacggatgagagcctgcgcattctcttcaaaagataccagcagggtcagatggttcttgggctttacaggcttgaacaaaacgccgagaacagacagatatatagaataaaaagcggcgaataaagatcgcaagttcatagattaccaatctcttttgctgttttatttgtttaaagctgtttcgtttgatcttctgcctgcttggaatacaggcttttatttgatttattatttctcaaaacggtaaaagcatacttcggaatgttcagcatccttttccatctccacggattcgtcaccagtctgtacagccattccagattcgttttgatcatccattcaggggcgcgtttcaccgttccgctgaacacatcaaagcttccgcccaaaccgatcgatacagcctgagggaaaagatgtttgtgttcataaataaattgttcctgatggggatatcctaaggcgacaaatacgagatcgggtttcgcccgggaaatctgtttggcgacgaagcgtttatccgcttcataaccgttgctggctccgacaacctcaatattcggatactctttgccgatccggttcaaaacggcgtcaagcacgtcttgtttagctccgtataaaaatatttttttagactgccggtttgcgaggccgagcagcgcaagaaacacatcgaatcccgcaattcttgatttcagcgggtgctgcatcaaacgtgacattaacacgacgccgataccatccggcaggacgaaatccgcggaagaaatgacttgatgataacctttgtctttcgccgcagcgtatccgatctcaggattgaccgtcgcaataacggctccttgcttctgtgcgatataataagtgtctaaatatgaaataaactcctgtaaatttccattaacataagaaaggttgtgcaccatttcagtctgcatctgccgtcctcctttttgtacgggattttctttcactttttcgtgacttaggctaagctttattttaacataataccttcagttaaacttaacaatagttttacaaaaatataaataagataacaatttctttaatcataggcgcaaaaaccctgctaaactcctattgtaataacatttgttaataagtggaacttaacttcgttttacattggcttaaccttttcagggctatgtgatataatgaggttccatgagtacgaaattggcactttagtgattaaggatacagctgcgcagcatttcagagcagttgcttgttatacgtatgatgatagaaaggagcttttgtttcatgaagaaggtcattacttacggaacgtttgatttactgcattggggtcatattaaactgcttgagcgcgcaaagcagcttggagattaccttgttgttgccatctcaacagacgagttcaacctgcaaaaacaaaaaaaggcctaccacagctatgaacacagaaagctgattctggaaacgatccgttatgtcgacgaagtcattccggaaaacagctgggatcaaaaagtacgtgacgtagcggatcacaacatcgacgtgttcgtaatgggagacgattgggaaggcaaattcgatttccttaaagatcaatgcgaagtcatctacctccctagaaccgaaggcatttccaccacacagataaaaaaagaaattgccggggtgtaatacggaattattgaatgcatgaactgttcaaagtacttcttatttgctgataaggagtactttttgatgcttaaataggtttgttataataatctgagggaatagtattattttgcagtgttttactaaattccatatggtgaaagggagaaaaaatttgtccaatcagcctattaacgataataatgagcttcccgatatgatgtattattttatctcaggaggcctcccggatgattacggaggtctgaccaaatcactattattgcgttctaaactattcggagaagagagtcaaaagaataccgcctttcttacttttaaatttgatttggaatttcggagaaaaaaaaacgaactctttgaaagaaagaaaaccgaccctcaatatacacaagttatcaacatgtatgatgactttttaagtaaaagaacaaaaggcaagcggatttattcggagaaaattgagctgaatcaaataaaaaaacatgtcagcaaggggaaagtaagcaaaactatctcaaaaatgttcggaaaatcatcaaacgattataatctttcctattattcaggcagtgacgacgtgcgttacgtagattacctgaatgatgaaaaacaagtaatcaaaagggaagaatacaataaagaaggaaaacccgtcattgtctctcattttgatacaaagacgaatcaaatcttccttcaggagtttatcaacagcgaaaatgtcgtttatctggaaaagcacttcatgtgggatgaccaaaatgaagcagtcaaattcacacattttacttggtactcagaagaaaaccctttaacatttaaagatgaatttgagttgcgcaggcattggattgatattctccaaaaagagaacgatcggcctaaactatttctggtcgacagcagactacaggataaacatgtcttcagagtgaaaaaagcgccgtcatcttattatgctgcgattattcacaataaacattatggtgataataagttccagatcaaaggacgctataaagaacttttcggccaaataaataaccttgatgccgtattttttatcactgaggagcagattgcagatttcagtttgatttcaggggaaaaagagacattcttttttacaccgcatacgattaataaaccgctcgatgaagaggttttgaaagttccgagcgaacgaaataaagcggttattatctctcggattgtaccaatgaaaaacctgacgcatgccgttaaagcgttcaaacttgttgtaaatgaaatcccggatgcgaaactggaaatattcggttctggaggagaaacagagaaaatcaaaaaggaaataaaagctcaaaacctcaagaataatgtattgctgaaaggctacacgaacaaccctgattacgagtttcaaaaagcgtggctgacaatttcaacttctcactttgaaggcttcggtctgtccaatatggaagcattgagcaatggatgcccggtcgtaacttacgattacgattacggtgccagaagcttggtagaagatggagtaaacggctatgtaattgaacaatataatatagaaaagctggctgaggccattatctctttaatgagagatgacagcactcacaaacaattttcacgtctagcctttaaaatggcggagaaatactctaaaccaaactatattaaaaattggtcatatgctcttttcaaaatggttgaagtgagaaaagaaaaggaacggcttgctgaaaaagtcggttctaaagaacacccgatcacatcttttgaaaaaaatgccaacggattagcgatcagcgtttcagtgtctgaccagaatgatgcatttgaaaaagtccgaatggttgggattgatcggaaaaacaaatctgaaatcatatccgtatccgctgatcaaccggctcagccattttatatagatcttgaaaagaacatccaaaaagaaaaaattgacgcaaatcatacttcggttcttgacttttacattcaatatataacagctgaccatatccgtattctaagaagggtatccagccgtgaagtcaatttcggcgaaaaagatcggtttatgaataacggatatactttcgaaccttatacgactgtgaaagggaatttctctattaaattaaacaaaaaggatcacatcgattaagtgaaatcggttaagtgaagagctttaattcagaggagcagaaaataagtatggatgaaaataccgtgagcaaatgtattttgaaaagcttaaaaaataatgtgggagacctggcactctctatttcacttgaaagcgaagaaccgttagctgaggaagtgaaatgttatttaaaattaaaagaacggcgttccggagccgaggatgttgttattttagagaaagagagcccggctcaatacagtgcatcaattaatattcactcgtttcctgaacctttagaaatgggacagacttatgatttttatgtggtactgggggaaccggcagcggaagaagaacagccgaagcaggtgcgtttaaccgtggaagctgaagcgattgagcgtgcctaccaccttgatcatacgactgagctgttaattttaccttatacaaccgataagggcaatttctctttaaaggtaaaaagagaagcgaaaattgtgaagtttgatgagattcagctgaaggcagaagagattatgatttcagggtatgcaggatatctaagttcggagaatcagctttcagttaaaaacctgcaatttgtcattaaaaaagggggagaagatcccgtagagaaacatttccctattaaaatgacgaaaaaaacggagaatattgaacagcttcgggaagatgcattcacccctgaaatttttgatttccaaataaaaattccattaaaagatattccttattctctggaaaaacgatttgtctaccgtatgtttatggagtttcattgtgaaaacgacgaagctgaacctattgttctcagcagcactccgcttgtgctcggagacagaaaaaataaactgaaaggcctcataagcgttgtgaataaagacagcggaccggtcaggtatgaggtatataaaaagaagaaaaagcagactgtctgtatccgtgtgaacgactacagcctgaaaacaaggatgagatacttcataaaagggaagaaaaaacgtttcatttccaaaatgaaaaaactgaaaaaacgcagaaattcccttattacgaaaggttataaagttgttttcagaatggcgagcaaaatgcctgttaaaagcaagaccattatttttgaaagctttaacggcaaacaatacagctgtaatccgagagccatttatgaatacatgcaaatcaatcatcctgaatataaaatgtattggagcgtaaataaacagtatgcagcgccttttaaagagaagggcattcaatacattaacaggctttctatcaagtggctgtttgctatggcgcgggcagaatattgggtcgtcaacagccgtctgcctttatggattccaaagccggaacatacaacctatcttcaaacatggcacggcacgcctttaaaaagacttgcaatggatatggaagaagttcatatgccgggtactaatacgaaaaaatataaaaagaattttattaaagaggcatccaattgggattatttaatttctcctaatgcctactcgtctgagatatttgcgcgcgccttccaattcgataaaactatgattgaatcaggttatccgagaaatgattttcttcataatgataataataatgagacaatcacagcgataaaaagaaggttaaacctgcctgaggataagaaaatcattctttatgcgccgacatggagagatgaccagttttatgctaaaggccgttataaatttgaccttgatttagacctgcataaattaagggaagagctcggagatgaatatctcgttattctgagaatgcattatcttgtggccgaaaattttgacctcggtccgtttgaagggtttgcttacgacttttctgcacacgaagatattcgggaattgtatatgatttcagatctgttaattaccgattactcttctgtatttttcgattttgcaaatctgaaacgcccgatgctgttttttgttcccgatattgaaacataccgggataaactcagagggttttatttcgattttgagaaagatgctcctggtccgttagtgaaaacgacagaggaaacgatcgaggcaatcaaacatatttcatcaccggattatcggcacccggtttcattcaaacctttttatgacaaattctgttatcttgagtcaggacattcttctgagaaagtcgtgaaaattgtgtttgaatctgaataatagaaaaacccctttgtatcaaggggtttttctattatgctttacaaaccttttagcagcatttgcatgcggcttgaaagtgaaaaaaaatttgatttctggtacaattatcagcgatgctttataaaatcaaatcaacctaaggaagattaaaatgaatgctgtagtgaaaatactaaaagagcaagtaacatcatttcctttaatcatgcgtttagcagcctacgaaacaaagtctaaatatcaaatgaattatttaggcgttttatggcagtttttaaatcctcttattcaaatgcttgcttattggtttgtttttggattggggatcagaaaaggggggccgatggctacaggtgccggagaagtgccttttattttgtggatgcttgcaggtctgataccgtggttttttataagtccgacaatattagacggatcaaatagtgtatttaaaagaattaaaatggtggctaaaatgaattttccaatcagttctttgccgtctgtcgccatcgcttctaatttgttcagttatgcaattatgatggtgatctatatcattgcattgctcgccagcggaatctatccgagccttcattggcttcaatatatttattattttgtttgtctgatggctttcttattttcgttcagcttgtttaattcgacaatcagcgtgctgatccgagactatcagtttcttctgcaggcagtgacaagacttttgtttttcctcctgccggttttttgggatattaactcaaagctgggggcagctcacccggaattggttcctgtcttgaagctgaatccgcttttttatataattgacggtttcaggaacagcttattagatggtcagtggttctttcaagatgtgaaatatacactgtatttctggctgttcaccttatttttgttaacagtcggttctgttttacacatgaaattcagagataagtttattgactttctttaatacgtaaggagattgtacgatgaaactaaaggtttcgtttcgaaatgtttcaaagcagtatcatctttatgaaaaacagtcggataaaataaaaggtttgtttttccctgctaaagataacggttttttcgctgtgcgaaatgtctcctttgatgtatatgaaggggagacaatcggctttgtgggaattaacggatcgggtaaatcgacgatgtccaatctgcttgcaaaagtgataccgccgacaagcggtgaaattgaaatgaacggccagccgtcgctgattgcgattgcagccggtttaaataatgctttgacgggccgggataacataagacttaaatgtttaatgatggggctgacaaataaagaaatcgatgagatgtatgaaagcatagttgagtttgctgagatcggtgattttattaatcagccggtgaaaaactattcaagcggtatgaagtcccgccttggttttgctatttccgtgcatatagatccggatattttaatcattgatgaagccctctccgtaggagaccagacattttatcagaagtgtgttgaccggatccaggaatttaaagaacaaggaaaaaccattttctttgtgagtcattccattggtcagattgaaaaaatgtgtgaccgtgtggcttggatgcactatggtgaattaagaatgttcgacgacactgaaaccgtcgtcaaagagtacaaagcatttatcgattggtttaataaactctccaaaaaagacaaagagaaatataagaaagatcaggttgctgaacgtaaaaaagaatcgcctgagcagcaggcaattgtgaaggaacaaaagaaaaatagtaaatccggatcagcagtcaatgctattcaaattgctattttatcaatactgcttgtgtttatggcaggaaccatgtttttcagcgccccgcttcgtactatcgcttccttcggtaagatcggatatcaagatgatgttaacaaggggaaagaccagatattggtgaacaaaaaaggtttcgtattaaaagaccagacgcaggcctataaagatacagagctgaaaaaaaaggcggaattccttattccgttcggtgctcaggtgaaagtggtatctgaagacaggcaatcaacaaagattgaggtcaataataaaacgtactatatcccggaaaatgcagcggtctataacgaaaaaagttcaaatgtgaaagcatccgctttttctccgtatgtaaagcagggtgatactgatcaacttgtgtcacatctcggtgagcgcgttaatgatattcagcaagaaatgaaagagctgcagaaagaagtagtgaacggccgggagatgctatatcttaaaaatggcgaggtcagttatgtagtgaataatggcaaggccgagcagcttgttttcagaggaatatcagctattactccggcagatctatccctgaataataaagatgttataaagggcagcagtgatcggcaatttattgcggcaaatgataaatacgcttttattatcaataacgataatcaaactttaacctgcattataaaataaaaagctgttggaataaatccaacagctttttttcttataattcatcttttcttaacaggtcttccatgaaagggataaggtgatcacgcagttcacgatcctgcatcgcaaattctaatgtagtggtaataaaacccagtttttcaccaacatcataccttttgccctcaaaatcgtaagcaaaaacccgctggatttcattcagcttttgaatagcgtctgtaagctgaatttctcctccggcaccaatttgctgttcttcaaggtacatgaagatttcaggagtgaagacataacgtcccagtattgccagattggacggagcagtcccttgagccggcttctcaacaaagttcttcacctgatatctgcggccttcacttgtcagcggatcaataattccgtaacgatgggtttcttcttcaggcacttgctgaacccctataatagaagaaagtgttttttcatattcatccatcagctggcgaagccctggtttttcagcttgaacgatatcatctccgagaaggacggcaaatggctcgtcaccgataaaattacgtgcgcaccaaacggcatgtccaagaccttttggctccttttgccggatataatgaatgtcagcaagattagaggcttttcggactttttctaagagttcgactttccctttttcttctaggtttctttccagctctggtgagtaatcaaaatggtcttcaatggctctcttgctttttcccgtaacaataataatgtcttcaatacccgcttcaaccgcttcttcaattatgtattgaatcgttggtttgtctacaatcggaagcatctctttcggcatggcttttgttgccggcagaaagcgtgtccctaaacctgcagcgggaattatggctttgcgtacttttttcactttaaagcaccttccttagcgtcacttaaatataagttaagatatctatacagactcaggcttgctgatattttctgtatacccgatatttcatttttaacacttttaatgatataagataaaccattattaaacaagttttatccgtaaagccttaatgatatatcctttttcatttatgggaaaaataatacaagatatttaactggcggatcatatcgtgtaaaatgggttgataatgaaaaatgatcacaaacttgatacaggagaaagagatatgaaaaaacttaaagtcatgacggtattcggtacaaggcctgaagcgataaaaatggcgccccttgtgctcgaattaaaaaaacgccctgaaatagaatcatatgtcactgtgactgcccagcatagacaaatgctggatcaagttcttcacgcatttcaaattaagcctgactttgatttgaatattatgaaagaacgacagacgctggctgaaattacttcaaacgccctggtaaaactggacggcctgtttaaggaaatcaaacctgatattgttcttgttcatggtgacacgacaacaacctttgccggaagccttgcagctttctatcaccagattgcagtcggacatgtggaggccggattgcgcacgggcaacaaatattcaccttttccggaagaattgaatcgccaaatgactggctcgcttgctgatatccactttgctccgactcagcaagcgaagcaaaatttgttgaatgagaataaaaaagaaagctccatttttgttaccggaaatacagcgattgatgctttgcatacaacggttcactctgaatactcccataatattattgaaaaaatcggcaatgacagaatgattttactgacggcgcatcgccgggaaaatttaggtcagccgatggaacttatgtttaaagccatccgccggatcgcagatgaattcagcgatgtgcaagtcgtttatccggtacacctgaatcccgctgtacgtgaagctgctgataagcactttggtgattcggagcgcgtccatttaattgaacctcttgaagtgattgatttccacaattttgcgtcaaggtcgtattttattttaactgattcaggaggcgttcaggaggaagctccttccttaggaaagccggttctcgtattgcgcgatacgactgaacggcccgaaggagtggaggcgggcactctgaaattagccggtactgatgaagaaacgatttatcagatggcaaaacagctgctgacagacaagcaggaatatgaaaaaatgtcgcgggcatctaatccctatggagatggcatggcgtcaagaaggattgctgaggggctgctctatcaattcggactgcgttcagagcgtcctgattctttcgaggtgtaacaaaaaagcagctccgcataatgtatgcgaagctgctttttctgcattagtttaaaggttgaggctgcttctcaattctttagtaatggaagcaagaccgttttcatctgctttataatagtaaattccgttgattttagtgccgtcacccttcagctcatgctgaatcactttcttgcgggcatctttatagccggattgaatatcccacatatcatcaaaggttaaattcgtttttacattgttctctactactttaaacatatctccgaatttcgtgacagaagagatacttgcccctttattgataataccctctataatctgccgctgtctgtcttggcgcccgaaatcccctttaggatcttcttttctcattcgtgagtaagcgagggcttcatcaccgtttaatgaaatattgcctttgctgaaggaataaccgtcatagttgaaagcgaatgtactgttgacagtgatgcctcctaaagtgtcaacgacatctttaaagctttccatatttactttaatgaaataatctacaggaaggttcaagaaattctccacagtatctactgccatttgcgtaccgccaaatgcatatgaatgattgattttatccatcgtgcctttgccgataatttttgtataagtgtcacgcggaatactgaccatttccgttgtttttgtctttggattgacagtaaggtaaatgagcgagtcggctcttcctttatcatttttacgttcgtccactcccatgatcaagacagagaacggttcttgtttatttattttcacctcagtgctgcgtttattcgatttgttaatgtcttcgtgaatactggcgacggttgatgccgctttatgccatagatagtatgtaaagccgccggaaactaaaataaaaatgccgatgattgtcagaaagaccagtaacaaagtctttttcttttttcttcgtttacttctcatctcaatacaccccatctgttttaaattggaaatcgaacttccagtaaatgaaatattttataatagaatacaataaatcctaatatagtcgaatgttatcgaaaaaagtttcaatgtttcttaatttttctttaaaatagataatatattgtcgataatccataatgaggtgaaaaaaatgaaaaaaattttcggatgtttgttctttatactgcttctcgccgggtgcggagttaataatgaaaaatctcagggcgaggatgcgggtgaaaagctggtaacgaaagagggcacttatgtaggactggcggatactcatacaatagaagtcactgtggatcatgaaccggtaagttttgatatcactgaagaatcagccgacgatgttaagaatttggataatggcgacaaagtgacagtaaaatatcaaaaaaatagcaagggacagcttatgctgaaggatatcgaaccggcaaattaatgaacagggggacgctgtaatcttgaaaacttgcaaacatttaataggactgactctagctgttgttatattgcttataccggcggtttcctttgcggcagattcaaatatatctgttaagctgacaaattacataggaaatcaatcaagcatttctttatctccaaccggtttttatcaggttaccggtgatcatgtgtctgtaaccaaccgcttttcgggggcatcccgatatgagacggcggctcttgcatctgactcccaatggacgaatcctaaaaccgttattctcgtcaatcgtgatgtttttatcgatgcattaccagtaattcctctggcaaaaaaattggatgcgccggtgttatttacacagccggacactttgacaaaaacaacagaaaaacagattgctaagttcaatcccgataatattctggtcatcggcggggctaaaagtatttcaaaggacgttgaaaataagcttaagtcttatggagctgtgaaaagaatcagcgggaaaaaccgttatgttctgtcagaaaacattgcaaaacaaatgggaaattacgataaagcaattgttgtaacaggtaatgtttttcaagacgctttagccattgctccgtatgccgctgcaaacggctatcccattctactgactgaaaaggataaattgccggattatgatcttccgaagcaagtcttaattatcgggagttcgttcagcgtgagtgatgctgtagaaaatcaaattaaaaaaacttcaactgtgcagcgaatacccggatcaacacggtatgaattgactgctaatatcattaatcagctaaagttgaaggctgataaagccgtcatgactaatggaacgaaatatgctgatgtcctggttggcgcttctttagccgccaaaaaaaacagccaaatattatatatcaaacaagatgatgttccttcagcagctaaatcagtgacaaaagagaaggcgtcgtatgcatacgactttatcggaagtacaagctccatttccgccggggttgaaaatgagctttcaaaccatttttacttagccggcggaagcacatacaacttacaaatcaataatggaaagttaaatcttaatcatattaaaacatatgggaattcattgagaataaaaccggaaacgtacaatgaatccaaccggatcagtttgaatggaaaagaatacttggggacggttaatttttcaatagagtcaggcaaatatatcagacctgtaaatgaaaacattccttttgaagattatttaaaaggtgtcgtaccgaatgaaatgcctgcaagctggtctcttgaagcgctgaaggcgcaaacggttgcggcaagaacatactcaattacgaagaccgggagcactgttgctgatactactgcttttcaagtatatggcgggtacagctggaatgccaatacaacgaaagcggtgcagcagacaaaaaataaggtgctgacttacaaagggaatttaattacggcggcttattcatcgagtaatggcggttatacagaatcaagcgacgaagtatggggttcaagcgttccttatttaactgcgaaaaaagacacaaaagatcctcaaactgcctggagtctgacgctttctaagcagcaaatcaatccggattcaattgatgtaaataagccggcctcttggtttgcttcaaagaatgagacaaatgcagctcaactgagcggtattaaaaattggattctgaaaaataaggaaacaggcgcttccgccattaaaattttaaaaatagaagatcttacattcagcggaacaactaaaggacagcgggctaaaacagcaactttgaaagtgaattacgctgtcaaacaaaacaatggaaattacgaggcaaataaaacatctgcaatgactgtgccggtgactgaattgagaacgatgatcggagcctccgtgtttaaaagcacttatgtgaccgtcagtcaaaacagttctgcttttacaatcagcggaaagggatatggacacggcatcggcatgagccaatacggcgctaaggcaagagcggattcaggagattcatatagttcaattttaaaattttattatccgggcactacattgactgactattaaataaacaagagcaggaggaaggcaattgcgttcttatcttaaagtcctgatcatttctatgctgggactcatcttatttatcccgtcagccttagctgacaacgcggttaaaagagtagggggaagcaacaggtacggtacggctgctgcgctttccaagcaggtgtattcaacagcgagtacagctgttgtcgtcggcggaggttcgtatgcagatgctatatccgctgccccgatggcatatcagaaaaatgcgccgctgctttacacaaacaaagataatttgtcatcagagacgaaaacccgtctgaaagaattaaaaacaaaaacggtcattatcgtcggcggaacgcctgctgtgtcagcaaatacagcaaatcaaatcaaagcgctcggcatcagtgttaagagaatttcaggaagcaaccgatatgatacggcagctaaagtagcaaaggaaatgcctgccgcctcaaaagccgttattgcaaacggatttttatatgctgacgcaatagctgcaattccatatgccgcaaagaacggatatccaattttgtttacgaataaaacagctatcaacagtgccacagcaggagctataaaaagcaaggggatcaaaagctctattgtagcagggggaaccgggagcataaatgcctctgtctttaagaaactcccttctccaaaaagaatcagcggaagcaatcgatacgaacttgcggccaatctagttcagcaattaaatcttccgacaggcaatgtattcgtcagcaatggtttcgggtatgcagactccatagcgggtgctgctcttgctgcaaagaaaaaacaatctatcattctgacaaacggcagcaatctttcaaaagaaacaagagtctttatcgggagaaaaaaattaagcagctttaccattattgggaataccccggctgtcagctcaaatgttgcaaaccagctgaaaaatccggcagcgggaaaaacaattttaattgatccgggtcatggagggaaagattccggttctataggtaacggcattttagaaaaagacgtcaatcttgatatcgctaaaaggctgaatacaaaattaaatgcttcaggtgctctgccggtcatgacgaggtctaatgatacattttattccttgcaggaaagggtaaataaaggtgcaaccgcaggagcggatttattcatcagcgttcacggcaatgcaaatgatgcaacttctgcaaacggaactgagacctactatgatgagacatatcaagccgctgcaagcaaacgcctggcaggacaaattcagcctaaggttgttaatgcattaaaaacaagagacagagcggttaaaacagcgccattctatgtcattaagtattccaaaatgcctagtgtattagtagagacggcttttattacgaatccgtctgatgcaagtaaattaaagcaagcatcctataaggaaaaggcagctgcagccatcaatgatggaatcgtgtcttattataagtaaaacttttatatatttgtgtacgagcctgctggtcaaaattgatcggcaggctttttcgttgttttccgctcataatgatccttttcaattatagtagcggccgtttatggatatgaatagatttacaataaaaaaacaataatcaaaacattctaataaacattaacgcttcctttacttccaattaacatccatctgctaaactcacggcataggtcatcaaacatcccaacaaatcgtgaggtgtgtgtcagtgggagcagagaaaagcatgaatgtaaataataactatgcagtgcggcaggggacttccgctgccgttacggaaagaacggcccgttatttggcttttaagcgattcatggacattgtgtttgcgcttgcggggcttttggcggcgctcccggtggtgggcctgttctccatactgattcgtctggagtcccccggcccggctttttataagcaggagcgggtaggcaaagacgggaagccgttttatttgtataagctccgctctatgaaaatagatgctgaaaaatcgggggcggtctgggcgctgaaaaaggatccccgcgtgacaaaggtcggcgcttttatcagaaggacccgtattgatgagctgcctcagctggtaaatgtgcttcggggagaaatgagcctgatcggcccgcgtcccgagcgtcccgtgtttacggaacagtttcaggctgagattccggggtttacggagcggctggccgttaagccgggattaagcgggtgggcgcaggtcaacgggggatatgacatgacaccgagggaaaaactgatgtttgacttatactatatccgcaacctgaccttttcattggaactgaagattatgctcaaaacgtgcaaagtgatctggaccggtgacggggcgcgataaaaattctggtcagcagacaaaaaagtagggaaaacgatgcctagtattacaaatcaaatcttgagcggcgccaaatggacaagtatttcgacagcgtgtattacggtcattcaaatcatccaattcgccctgctcgggcgggtcatgtcactggctgaattcggtcttgtcggcatgatcacaacggtagtggtgtttgcccaaattgcgcttgatatgggttttggcgccgcgctcattcaaaaagatcatgtgactgataaacagatgtctgccttgtactggctgaatatcataacggggcttgcgctgtttgcgctgctgtttttcagcagtccgctcatcgccgatttttatcggcgggaggagcttgtctatttaatccgcgtgctggccgtcatgtttttaatcgcgccgatcggtcagcaataccagtatatgctgcaaaaagcgctggcatttaacacgttaagcaagattgaaatcttttcaaatgtgctgtccttcgtgtatttggcggccgcggttttttatacggacccgattctcgcctatgtgatttctcaggtgctgctgcaatcgtcaaaaggcattctgtactggatgtcctgcagaaaaacatggagaccggcgttggtttttgatctgaaaggaatgaaaggcttcttttctttcggggcctttcagctgtcttcccggcttgtgaaccggctcggggcgaatattgatatgattctgatcggcagttttatcggcgccgaggcgctcggcatttacaatctggcctaccagattgtcacgcttccggtattaaaaattaatccgatcattacgagagtcgcgtttcccgtctttgcgaaaaacaagcatgaaaacagcgttatcagagaaggatttctcaatatgaccaaaatactcgcgctgatatcctttccgcttttgctcggtttggtttcagtgtcggatgcattcgtggcttcggtattcggagaaaaatggctggcggctgtcccggttttaaacgttctcgccatcgtcgggattttaagggttctgatgaatccgaacggatctgtgctgctcgcaaaagggcgggccgatctggcgttttattgggacgccggggtgatgctgctgtatggtgcatctttgtacgccgccgtgctgtccggaaatctcttgacggtagcctggacgtacgctttcatcagcatcctgaatttcctgatcgggcgctggctgttggcatatgtcattaagctgcgtctgtcggcttacttcaaagccgtggccaaaccgtttctgcttacggcggcaatgggtgtcatcgcctttacagccagcttcggcacggagcggatcagccttgatgtcaagctgcgtctggcaatctctgtagtctgcggcgcgttgtgttatttattcctgttaggaaaagcttatccgcatatgaaaagtaaattaagaaaaggacgtttgctatgaaggtattgtggatgacaagtgtatatccgagcagtgagaagccgggagaaggggtttttcatgagacgcaggcccaagaactgagaaagcttggcgcggagatgactgtcatttgtccgcggccgaaactcgccgcgccattccgggtgctgaaaaagacgtatcggcaaaaggatataaggccggcgcatgaatggcggaaaggcgtgtccgtccaccggccgttttatcaggcggttcccgggcagctgaaatgggcgcagccgcataaaagaatggcggcatcggttctttccgcgattagaaatcatggcctgaagcccgatctgattcacgcgcatttcgccatgccgtcaggcggagcggccgccattgtgtcaaaggctttaggcattccgtatgtgctgaccttgcatggcagtgatgtcaatgtctatccgcattacagcaaaagcgctcatcgcgcatttacatttgcggtgcgggaagcagccgatatttacgctgtgagcggcagtctgcgggaacaaatgaaaaagctcatcgaagcggagtgcagcgtgcttccgatcggcatcacgcttgacgccttccgaaaaaggaacgagacgaaagaagccgtcagaaaacggctcggccttcctccggataaaaaactgatcgtgttcatcggcaggcttgtcaaagagaaaggtgttttcgacttatcaaaagccgttcagtcattggatgaaaattatgaagctgtctttgtcggtgacggtcccgccgcatcttcattgcgtgaagccgctcatatcgtcacggggcaagtgccgaacgacaaggtacaggactatctgctggcctcggatgtaatggcgctgccgtcctacagcgaaggcatgccgactgtggtcattgaggcgctcgctctgaaggtgccggtaatctgcaccgatgtcggaggattggcttctttattcgggaaacaccgggggttgctgatcaagccgggttcacctgagacgctggcagaatcgattctgcgatatgacggaggagaggcttggacgccgcaaacagccgaggaactttatcaaaccgtccgcacgtattttgacgcaagccaaaacgcggaagcgctgaaagagaaataccgatccgtaatgaaccgggccgggcaagaggagaacctttcgaaagagggatgaagctgtgaaaaaaatcgctgtattaggaacagggtatgtaggtcttgtatctggaacttgttttgcggaaatcggccatcatgtgacttgctgtgacatcaatgaagcgaaaatcagaagcttgcaaaacggagtcatcccgatatatgaaccggggcttgaggaattagccgaaaaaaatgtcagtgccgggcggttatcctttacggccgatattgagccggctgtgaaagccgctgatatcatctatatcgccgtcggtacgccgatgtcaaagacgggtgaagccgatctgacctacattaaggcagcggcgcaaacaatcggagaacagctgaacggatacaaaatcattgtcaccaaaagcactgttccggtcgggacgggaaagctcgtttaccaaatcgtcagcgaagcgtcaaagggaaaatatccgtttgatgtcgcgtcaaatcctgaattcctccgcgaaggttcggcggtgcgggatacgatgcagatggagcgggcggttatcggcgccacaagcgaacatgccgcttcggtcattgaagagcttcataagccgttccgtacgaagatcgtaaagaccaatcttgaaagcgcggaaatgattaagtatgccgcaaatgcttttttagccgccaaaatatcttttattaacgatatcgccaatatttgcgaacgtgtcggggcggacatttcccacgtgtcagaaggcgtcggtcttgacagccggatcgggaataaatttctgcaggcgggcatcggattcggcggatcctgctttccgaaggatacaacggctttattgcatatcgcaaacgccgccggctatccgtttcaaatgatggaagccgtcattgaaaccaatcagaagcagcgggtccgtattacggaaaaattgaaccgcgccatcgggcccttaaaagggaaaaccgtggccgtactggggctggcctttaaaccgcacacaaatgacgtccgctccgccccggctcttgatatcatcacaagtcttaaagagcagggcgctcacgtgaaagcgtatgatccgatcgcgattcccgaagcgtcagcgatattaggagacggcggcattgagtatcacacagagctgtacagtgccatcaaaaacgcggacgcatgcctgattacaacagattggccggaagtcaaggagatggatcttcagagagtgaagcagctgctcaaacagccggtcatcattgacggcagaaatatgtttccgctggagtatatgagggtttcaggattcacttatcattccgtcggacgtccggcggttcatgccgatcggcaaataaaagaactggcaagatagaaaaagatttgtcttcaggctctcggcagcccggctcggctgccggttttggaaaggggtttgccatgtgagtatcaaatgttcagcggcacatgttcttgtgctgcttgccgctctcattacaggaggattcatcatgctggaggcggtcagggcggatgccggcttcggaaaaatcaccgtgctgctgcttgccgccatgatcggcattgccggacttgctttgctatccgcctttacaacaaacggtcagatgtttatggggctcatttatgtactgatcgcgtgtacatttttaaaccaggccttctttgcggtccatctcggatttttcagcttatttatataccggctgttattaatcggagcgggcgcccttcacatcgccggcatcctgacaaaccgttatcatattgacagatggaatcgggtgaatgtaaaagggattctgatgtttttcgccttatggtttacatacggtctcctatcgttattgtgggcaaaatccgtgacgtacgggattaaatatttagctttaatgggaatgggcatgtttctgatttatcttattgtcatgttcattcagcgctttgatcagctgatggttttttacggcatatggcttgtgatgaccatttttgtgatggcgatcggcttttacaaccattttacacaccaccatctgccgagctccacgctttataacggcccgcagtacaaacagcattatccgacgtccgttttctttaatcaaaatgatttcgcgacgtttttgtgcatcagtttctttctgtatgcggcggcggtgaaaaatatgaaaaacggctatgtgaaggccgtcagcctgctctttgcgatctgcgctttgtatttaatcattttgaccggttcgcgcgcgagtctgctgggcatatgcgcgggggcggctgtatacgtcttcatcctgctgccttccctgttgaaaaaactcgcgctgtacgctgcgggagcgggtgcggcgctgtttgcggttttatttgcgggccgtatcaccaatgccgtcttgaatctgttttcagctccgcaggcgatgccgggacagcaaccgcttccttccaacctcgcgagggcgaatcttttaaagaacgcctttcactatgtgattgattcctgggggttcggagtgggtgccggaaacgtctcttactatttaaaagcggagcccgtttatgatacgggcggcgtagttgaggtgcacaactggctcgtcgagattatggcgaacttcggcgtgcttacgatgctcggttacctgacagtctatttgttccttttttggacactttataaatgtcatgaaagaaaatcggaaaatcagtcaagactggtcacagaaggacttatcacggcgatggccggttttttggtaagcagcatcagcccaagctccgtatcaaatttatttttccactgggtatttctctcgctcgtgatcgcggcggtcaatatattgaggcgtttacaaaaggagcctgccgtcacggcgtactatgaaaaacagggagatgcgagatgaaggatatgttgacaagaataacccggcgtatcaaaaagaatatcatttggatcattgcgctgcccgttgtgttaggggcggcgggatatgtattgccgtcaaaaatcagcggaaacagcagttttacatcagaagccgcgatcgccgcgggaaattatgatcatccgctttataacaatacaaaagaaatcccgctccttttgacgagcgatgcctttttaaagcaggctttgcctgataaaacagacgaagaaagagcggccgtgaaaagtaaactgactgtcgaaacacaatcagattcattgatcacggtcagctacagcggccaaaacaaacaggagaccgaatcggtgtttcaagccgtcataaaaacttttctgaagaatgaccaggacctgtttgaaaaacgggcaaaagtagtgcggcagagtattgctgcgcttgaaggagaaaccgtcagcgcggacgccaaagtggataaggaacgatttttatacgaattgaaaaatacgcagctgaacctgaaagcggccggcgtcatcaattcagagccgatgaatgaaacggcgggacaaggcatgccgccgaaaaagaaagcggttctgggcgttttaatcggcattgcagttgcatttatgttcattgtcattcctgagttttttagagagtccttgtaaaaatctgcgatggagatgtgaccatgacaaactggaaacctttcgtatctgtcattacaccgtcttataacgcaagtgaatatatcgaagacacgattcagtctgttttacatcaaagccacccgcattgggaaatgattatcgcggatgattgttcaacggacggaacgagagatattttacggcaatatgaacaaaaggatgagcggatccgcgtcgtttatttagagaaaaacgggggagccgcggctgccagaaatacagcccttaaacatgccaagggccgttatgtcgcatttctggacagcgatgacagatggaaaaaggaaaagcttcaaaaacagcttgcgtttatggcagagcggtcctgcgctttttcatttacgggctacagcgtcatggagcaggacggaacgccgacggacaaaacgattcaagcccctgaaagcctgtcatatgatgaagctttaaaaaacacgattatcggctgtttaacggtcatgattgacagagagcagacagggcagattcaaatgcctgatatcagaacgcggcaggatttagcgacatggctttccttgctgaaaaggggatttacggcttacggcctgaatgagtgcctttcagaatacaggcttgtgcagaattcgatttcaagcaacaagtggaaagccgcaaaaaaaacgtggtttgtttatagagaaattgagcgcctgcattttatcaaggcttcgtggtgttttatgcaatatgcgaaaaacgcggtcttgaaaagactgtaggcgtcagaggagctgggtgatgaaggtggaaccgattattcacgtaatcgtcggagcggcggaatgggggcatgaccggctgagatacagacggcaccggctggctgaatttctcgcccggcaaaaagaaacgaaaagcgtcatttgggtatgcccgtctccgcgagccaatgatggtcagatggccgggatcgccgagggaatccggcagttcactgtaaaggatctcatgcagaaaaaagctttccgcttcggcaggtatacagacatgtgctacaggcataagctttcaccattgttgaacatgctgaaggaagaaggagaaggggcccgctgctgcttatggtacaccttccccggttttccgctgctggcagatctgtttccttgggatgaagtgatttacgattgcagtgatctgtgggccgctccgatcagcggccggtccggagttctgtcaaatgttagaagaaacatcattaaacaagcggaaatgagaatcatacagcgtgccgattccattacgtgtacatctgactgtctgcaccaagaggtcggaaaaaagctggagaatccgcaccagaaagtgttcaccattgaaaacggagtggaatatgacctgttttcacgggaaaataaacagccggatgaagacattttacggggacggaacggaacggttctcggttttatcggcggaatcaaaccgaagctcgattttgcgcttatggcggaaacggcagatgtgaggcctgattggacgattttattggtaggcccgaacacggctcaggacgatccggatttcgagtcgcttttggaccgtccgaatgtcatctggacgggacctgccgcgccgaatgaagtgccgtcctatatgcagcttgtcgacatcggcatcatgccgtataaaaattcaccttataatgacgcggtatttccgcttaagctttttgaatttttagccgccgggaaaccggttgtcggctgcaacctttcttctacgtcaaaaatcaaaaggcctttcgtctatgaatacgttgaaggcagtgaccccgcagatttcatcgcggcctgcgacgcgcttctggcagcggaccgcagcggatcatatgaggctttgcgccgtgaattggcccggaaacgggattggaatgttttattcggccgaatgctcgaatgcacgggtatattgaaaaatgcgcaatcccattaaaagggaaagcgcatttttgatttgcgtgtttctttttgatgatgcttgttataataactagtaagaattataatggaaggaacggttcaatatcagaaaagacttcatataattccaaaggagacttctttatgcttgacgaacgcatgtttcgcatagttgttgcgttttttgtctctctgctaacggttttaatcctaactcctatcgtaaaaaaaattgcgatcaaaataggtgcagttgaccagcccagcaaccgaaaagtacatgataaaataatgccccgtatgggcggcttggccatctttatcggcgtagcggcgggtgtgctcgcggccggcatatataatgaaacgaaaatgaccgccatcacggtgggtgcgtttattattgttattttaggaatccttgatgataaataccaattaagcgcaaaggtaaagtttttcgtccagctggccgtggccattatgattgtgagcacgggactgaaaatggactttttctccgtaccgtttttaacggaacgtttagaattgggatgggtcgcttacccgctgactgtgttatggatcgtcggtattacgaacgcgatgaacctgattgacggtttggacggactcgctgccggcctgtcggtcatcggactctccactatcgccgttatggcgttgtccggagggaaaatccttattctgtcactttcacttgtcgtgataggaagcacactcggatttttattttataattttcacccggcaaagatatttatgggagataccggatcgctctttctcggatacgtcatctcagtactctcattattaggtctttataaaagtgttactttattcagtatcattattccgatcatcattttgggcgtgccgatttttgatacgacattcgccgtcatcaggcggattttaaacaaacagccgatctcagcgcctgataagtcacatatacaccaccggctgatggccttcgggctgtcacaccgcacggctgtcattatcatttatttaatcggctttattttcagcgtcagtgccatcctgctgaaaagcgcgaccatttggctttcgctgtttattatttttgtattgattgtatttatgcaaatcatagcagaggtcacagggttagtaaatgaacaatttaaaccatttaccaagttttacaaaagattggtaaagaaaaattaaaaagagcagatcatgcgaatggtctgctttttttgtggattctgctattctcttattatataaaaaaacccgatcctgctcaaaggatcgggtttactcttaatagcctgttgtgccgccggactgtgtgctgtccgtaccgtttgcaccagcagtaccgttggttgaatcggttgtgccgcctgttcctgtgccgccggaagttgaatcggttgtgccgtctgttcccgtgctgtcggaagtcgaatcagtcgtactgtccgttcccgtgctgcttccggatgggtaatccagatgtttctgcaattcctgccgtactttttcgagattggtcggatcaggctggaaataatacgttccgcccgtagacgcggttccgccgccgcctaaatataaatctgatcctgttatagtcagtgtatcaatctttttgctggtaaagccgctgtaaatctgctgaagggcgagtccttcagtgattcggatattcgtttgtacattattgctcgctgtttcagcgattttatcaattttagcaatatttccagctctggacatttggtcgatcagtgcgtttaagatttgcttttggcggtcattccggccgaagtctccgcgcttatcctgttttctcatccgcgcgtaagccaaagcctgctcaccgttcaaatgcatgtttcctttcttgaaatagatccgtttctttttactgacgtcactcatctcgtcgaagtcaaacggcacttttacatcgaccccgcctacttcatcaataacatccttaaagccattgaagtcgacagtgacatacttatcaatcggtatgcctaataagtcttcgacggttgagacggtttcatccgctccgcccttagcaaaagccgcattgatttttgattttttaccggttgtgtcgccggcaagcgtcacccgcgtatcacgcggaatactcagcattttcattgttttatttctcggatcaagggtaacgacaataagagaatctgatcgtccgccttttccgctggtggcataattttcgatccccataaacaaaatggagaacggttttttcttcatattgatgactttatcccgcaattttgatttgtctccgcgggaaagggcatcatatgcattatctgccgcattgatcgttttgtatactttgtatccgccaaatccggcagcgactaacaaaacgagagtaagcagcagcaaaatccgtttgaatatgatctttcgtttgcttttctttttctttcgaacacgcactcttacacgttcagccattacattagtctcctttagggctgacgtctgtttctaaatacgtcagttctccctctgtattcttactcttgccgttcgtcagttctgtcatccattttagaaacgcttctttgtctttttcttcaacgtacgtttcaaattcgacatgatccgcataatggatatctttcagtaaaaaaactgattctctcagttcgttctctatcttgccgagccacgtataatccgctgatgtatgcataatccgcatcagcttccgctccgtaactcctatatgatttaagccttcagacactgacttcccatatgcacgaatcaatccgcctgcaccgagctttattccgccgaaataccgggtaaccaccgcgcaggtatctttcagacctcgttttttcagcacttccagcatggggacgccggctgtgccgcttggttctccgtcatcattggccttttgtatatggtcggtttcgccgatcagataagctgagcagttatgagtcgcattccagtgctgtttttttatcttttgtataaattcctgcgcttcctcttcagaagcagcacggctcaggtgacagataaaacgtgatttttcaatcacaatctcatgttcacccgcttctttaacagttaaatagctgtgcagcatgattgctggaccctcctgacaagcattaaaagacttgtttctacaaattcgaacagactttagaatttttgcgcatattttggtatcatgaaagagtaagatactatataaaaatgtttttttctagaatatacgcattctttcattataattcgacataaattgcagttcaattacatttataataaaaatacataacaacaccgttacggagggagacagatgaataaatcgaagatggactccaaagttttggattctatacttatgaaaatgctgaaaaccgtggacgggagcaaggacgaggtttttcaaatcggagagcagtcgcgccagcaatatgagcagctggttgaagaactcaaacagatcaaacagcaggtgtacgaagtcattgagctgggcgacaaacttgaagttcatacgcggcacgcacgaaaccgcttgtctgaagtaagcagaaatttccataagttcagcgaagaagaaattcgcaacgcctatgaaaaggcgcacaaacttcaagtggaactgacgatgatccagcagcgtgaaaagcagctgcgggagcgcagagatgatttagaacgccggcttttggggcttcaggaaatcattgaacggtcagaatcattggtcagccaaataaccgtcgttctgaattacctgaatcaagaccttcgccaagtagggcttcttcttgccgatgcgcaggctaaacaagatttcggtttaagaatcattgaagcccaagaggaagaaagaaaaagagtttccagagaaattcatgacggtcccgcgcagatgctggcaaatgtcatgatgagatcggaattaattgaacggatcttccgcgaccgcggcacggaggacggatttcaggaaatcagaaatcttcggcagaatgtgcggaatgccctttacgaagtcagaaggattatatatgatttaagaccgatggcattggacgatctcgggctgattccgacactgagaaaatatctttatacaactgaagaatacaacggaaaggtgaaaatacattttcagtgtatcggagacacggagaacaaaaggcttgccccgcaatttgaagtggcgcttttccgtctcgctcaggaagccgtcacaaatgcactcaagcattcagaatcagaggaaataacagtaaaagtggaagtaaccgctgattttgtcgtccttatcattaaggacaacggaaaaggctttgatattaaggatgctaaacaaaagaaaaacaagtcattcggcttgctgggaatgaaagaaagagtagatctgcttgaaggaacgataacgatagactctaaaataggtcttgggacatttatcatgattaaggttccgttatctctcggcctataatttgttaaatagagccaaaagacatattgaccgaacagcggcgtatatagaacaataggataaggaggcgtagcgtgtgactaaagtaaatattgttattatcgacgaccatcaactattccgtgagggtgtaaaaagaatattggattttgaacctacctttgaagtggtagcagaaggtgacgatggagatgaggcggctcgaatcgtcgagcattatcatcccgatgttgtcataatggacatcaatatgccgaatgtaaatggagtagaggctactaaacagcttgttgagctgtaccctgaatctaaggtgattatcctctccatccatgatgatgaaaactatgtgactcatgctttaaaaacaggtgcaagaggctatctcctgaaagagatggacgcagatactttaatcgaagcagtgaaagtggtagccgagggaggttcttaccttcacccgaaagtaacccacaatcttgtcaacgaattccgccgtcttgcgacaagcggagtttctgctcatcctcagcatgaggtttatccggaaatccggagaccattacatatattaacgagacgggaatgtgaagtgctgcaaatgcttgcagacggaaaaagcaaccgcggaatcggtgaatcattgtttatcagtgagaaaacagtgaaaaatcatgtgagtaatattttgcagaaaatgaacgttaatgaccgtacacaagccgttgtcgtggccattaaaaacggctgggtagagatgcgttagccatgtgtgagaagacttgcctgttaaggcaagtctttttttacagctgcatatctattaaaatacttattaagtacttaataaggcaggtaaagtgatgaagattgcagttgtaacagacagtacagcatatattccgaaagagatgagagaagaacatcatattcatatgatccctctccaagtggttttcggtgaaaaaacattccgcgaagaaacagaactcgactggagaagtttttataaagaagtaaaaaatcatgatgagctgccgactacgtcccagccttctttcggtgaattaatcgcattatacgaagaactgggcaaaacatatgacgcagtcataagcatacatttgtccagcggaatcagcggaacttataacagcgccgcctcggcaaacactatggttgatcatattaaagtttatccctttgattcagagatcagctgtttggcacaaggtttttatgcattaaaggcagcacagctcattaaagacggtgttgactcaccggaagagattataaaagagctggaagaaatgaaaaaaacagtccgtgcgtattttatggtggacgatttatcacacctccagcggggcgggcgtctaagcagtgctcaggcttttatcggcggtctgttaaaggtaaagcctattcttcattttgacaataaggtaattgttccttttgagaagattcggacacgcaaaaaagcgatttcgagaatttttgagctgtttggggaggatgcaagtaaaggaatcccgatgcgggcagctgtcatccatgcaaacagggaagaagaagcggcggatattatacaggagttaagcggtaaatatcctcatgtcgaattctataacagctatttcggtgccgtgatcggaacccatttgggcgaaggcgccatcggaatcggctggtgctttaaaaactaagtgaaaatctccgttttcaagggcggagatttttttattattaagttttcgtgattcgacaaaaaaattcccggcaggcatactttgagcagaaaggaggcagggagatgtccgaaggtgcttcagaattttcagaggtgcgggatttcttttacggccggcatttattgagatctgagataccgttctcagaccagcgtatcaagcgttttacagaaaaagaatatataacggccgagccgtcaatcatccgccggaaaaaccgttacgtctgccaacgatgcggtcagtctgatcaagccagctttgcggcattttgggcgccctctgccaaaaggcagattacctattgccgtgcctgtgtcatgatgggaagggctgatgaactgacatcattatattcttggaatcaaacccctgaaaacagctgggagcctgtaaagctttcttgggaaggaacactgacagacggacagaagcgggcggctgccgcgcttacagatgcgataaaagagagacaagagcttttagtatgggcggtttgcggatcagggaaaacagagatgctgtttccgggtatcgagtttgcgctgaatcacggtttgcgcgtttgtgtcgcaactccgcgtacagatgtcgtacttgaactgctgccgagactgaataaagcatttgagaaagtcgaagtttctgctttgtacggcggcagcgaggacaaaggccgcttgactccgctgatgatttcaaccgctcaccagctgatgcgctaccgagacatttttgatgtcatgataatagatgaagtagatgcgtttcctttttcagccgatgagacattaagattcgctgttgataaagcgaggaagaaaaacagcgcccttgtttatgtaacggcgactccttcagacacattaaaaaagaaggctgaagccggtttgctgaaaagcgtccgcataccggccagatatcatcggaaacccctcccggagccgcgttttttgtggtgcggcaattggaagaagaagcttcagaaaggaaaactgccgcgctctgtaacggattgggtccgccaaaaacttcaattacagctgccggttttcttattcgtcccgtctgtacacgtattgaaaaagacaacggattattttcggaaattaaacatacgggcagaaggcgtacatgcggaagacacattcagaaaggataaagtgaaacgattcagagacggccggcttgacctgctggtaacgactacgattttagaaagaggggttaccgtgcccaaagttcagacatgtgtcctcggcgcagaagcacctatctttactgagagcgcgctcgtacagatcgcgggcagaacgggaaggcattataaacatttcagcggtgatgtcgtcatgtttcatttcggaattacaaacggaatgaaaaaagcaaaaaaacatatagaacatatgaacaaattggcacaaaaaagtaaattgttggactagttaatttcagaaaacgtgatacagtatactcatactttcctatgaggagctgtcagcatgcttgtcaattctaaagaaatcatattaaaggaacttctcgaccgctatatgcctaagcttcatatgaaatgcacatgccgggtatgcaaaaatgatgtactggcactttcactaaaccgggctgaaccggcatatgttacagataaaaagaaagttgcttatgcaaaagcagagatagttgataaacagaaaaatacggcgctgcttgtcattctggctgaatcagcggcgattgtttcggttaatccaagcgagttctgtgaaactcgggaaggagcgtaatatctctgaattgtttattgtgtgactcaccaatttcaagttcattgacttggagatctctgttttctctggcgcccgagcaagagatatgcagcatatgcagcagccaattcgaaaaaattgaaggtcccgtatgcagtatatgcgggaggcctcgggagtcaaatgaaaaatgcgctgattgtgcggcccgggaatcaaaaacggaaaagcgctttttgctgcggcaaaaccgttcggtatatttgtataatgatgcgatgaaggactcattggcccggtttaaattcaggggtgatgcgaaaatcattcaagcatttgaacgtgactttgctgccggctttaaagcggcatatccatcaaatacacatactctcatccctattccgctgagcggcgaacggctggcggaacgcggattcaatcaatccgagctgctggcctctctgctcggaatgcccgtcattttccccctcatccgactgaacaatgaaaaacaatccaaaaagagcaaaacagaaaggctgtccgcagaaaaaaagttttcagcagccgaaaactccgccgaaggtatgaacgtcatcttaatagacgatatttatacgacgggcgccacactgcatcaagccgccgaagtcctgctgacagcgggtaaagcgtcatcggtctcctcttttactttaatcaggagctaaatcattctttttttctgccgatataattgatagaaatataaggcagattaaagaaggaataggagttaatacgatgggtgaattggcgaattgtccaaaatgcaatgctttattttttaaaacgaacctgcagaccgtgtgccaggcatgtattaaagaagaagaaaaagcatttgaaaccgtctataaatttttgagaaagcagatcaacagacagtcgacgatgcagcagatcactgaggaaacaggtgtggatgaagagctgatcctcaagtttatcaaacaaaaaaggattcagatcagccagcttccaaatttggcatatccttgcgaaaggtgcggaaatccaatcaggacggggaaattttgcaagtcctgtcagacagatattgagtcgcaattagatcatatgaaccaaaaaacagccgctgaattcgatgaaaaaaacagtacaaaagacacatactatgcctataataccaaaaacacctgattccctaaactaactgataacgcagtcgataaaagaattagactgcgaacagaaagcgagaggaatcctatgaaaatcaatcagtacggaacacaatccgttaatccataccaaaaaaattacgaaaagcaagccgtacaaaaagaggctgcaaagccgaaggacaaagtggaaatttcttctcatgcaaaagagcttcaaaatgcgtcagatgcggtcactaaaacacgtcaggaaaaaatcgctcagcttaaagcggatatagagagcggaacatataaaatagattcaaacagcatcgctgaaaacatagtgaatttctataaaaagcaataaaaaggagaaagccaatgtcagcaaagccaattattgatcaactgaggcgactttgcgcactgcatgaacatctgctcacgctgtctgaggagaaaacggaagcgctgaaagcaggtaaaacaaaagagctctccaacatattgaccaaagagcaaaagtatattcaggcaatcggacagactgaggaagaacgaatcaggttaacttctcagtttctcagccgcggtgaggacaatacaattgctgcatgcatctccagaacttcaggcagtgaaaaacaggagcttgaagggttatttcactctttgtctgcgcttcttgaccgtctgaaagaagtgaatgagatgaacaaacagctcacgattcaggctttacaattcatctccggggcattcgatatgatcatgccgggtgaaaaagagaatatgaattataaagagccgcaagcggcgcgcaagcctgtcagccgtttgacattattcgattcaaaagcttagaacggaggattttcaatgccatcgacttttatggggctcgaaacagcaaggcgtgcattgagtgcgcagcagactgcattgagcacagtttcaaataacgttgcaaatgcaaatacagaaggatatacgaggcagcgcgtcacattacaatcgacgagcccttatcccgcagtatcaaaaaacagtgatctgacggccggccaaatcggaacaggagtaaaagccggttcagttgagcgcgtcagagacagttttttagactatcagtacagaactgaaaatacaaaattagggtactatacagcccgttccaattcattgtcgcaaatggaaggcgtcatgaaagagcttgacgataacggattaaacggatcgctcagttcgttttggaatgcccttcaggatctggcgacgaatccggaaaatacgggagcgcgctcagttttgcaggagcaggggaaatctcttgccgaaagttttaactatatatctacctctttgactaacattcagggtgatattaaaaagaacctggataacacagcggatcaggtcaattccattctcaatcagctgaatgaccttaacaatcaaatagcggcagttgagccgagcggtatgctccctaatgatttgtatgaccaaagagacagattgattgatcaattatcttctatggcaaatataaaagtttcatataataagtcgggcggacatgccttggcgactgctgagggcacggttaacgtcgaattgctgaacgggaacaacaattctctcggtacgctgctcgacggtaacacaaaaacagtttcagaaatgaaaatcaactacgacaaggacagcggcctcgtgtcgagtgtgtcagtcggcagcagtacggtcaacgcggatgcatttaccggtaaaggctcacttttaggtcttattgaatcatacggctatatgtcaaatggagaagaaaaaggtctttatcctgaaatgctgacggctcttgacaatatggcactatcctttgctgacgcgtttaatgcagttcatgaaaaagggaagacctatacaggcgaacagggtgcagcattttttgatttcagcggtgatgaagcggtgccggcaaaaggtgcggcagcgaaaataaaagtcagtgacaaaattcttgcgtctactgataatatcgcagcgtcgttaaacggagaaaaaagtgacggcacaaacgcgacaaatcttgcagccgtacagaacagcaagctgactattaacggtgaaaccactacaattaatgacttttatgaatcccttatcggaaagctgggcgttaattcacaaaaagcggccaatcttatgaacaactctgaaagcaacaccctttcagccgatgaacggagacaatcagtcagtgcagtttctttagatgaagaaatgacaaatatgattcagtttcagcacgcttataatgcggctgcgcggatcataacgatgcaggatgaaatattcgataaaattattaacggtatgggcaccggaggaagataggagataagtaaatgagagtaactcaagggatgatcgcaaaaaattctcttcgatttatcggctcaagttatgacaagctcgatcggcttcagcagcaagtatctacggggaaaaaaatcacgaaagcttctgatgatccggtcgttgcaatgaagggaatgcagtaccgtactcagcttgcgcaggtaaaccagtatcagcggaatgtttcgcaaggctttacatggctggaaaactcggaatcaagcgtaaactcggaaacggatattatggggaaaatccgggacttgatggttcaggcgaaaagtgattcgaacggtgaaacagaattgaaagcaatcggtacagaaatcggccagctgaaaaagcagctcgtttctgtcgcgaatactcaggtaaacggacgttatctgtttaacggaacaaattctgacgtcccgccgatcactgaaaatgccgacggcacatatacgtacaactatgagaattataccggtgcttcggatgttaacatcaacatctcaaacggagcagtgcttaaagtgaattctgatccaaactcagctttcggaggcgtcgcacaaaatggagataatgtatttgaatttctcaactccttagaagcttctttaagcaaaggcacgctgtccgaagcagattcagatcaaattctgtcagatattgacggttttactgataaaatgaatgctgaaaaatccaatatcggcgcacgcacaaaccgattggaactcattcagacaagattggaatcacaagcggcaaccgctgaaaaagtattgtccgataatgaagatgtagaaatggaagatgtaattgttgattatttatctcaacagacggttcatagagcagcgctgtcagtgaatgcgaatatcatccagccgtcactgattgactttctgaaataatataactgaccgtcttcaatatataaaaaagcgactcacaccagggagatcgctttttttactaaaatactataaacaggggggatctctgtgcagataccgagattgattattgacagtgtgcctgctaaaatcggtataacctttcaaaaggaagaaatcgagatggaacagccgcccgctgacttggaaatcgagcagccgccggcagagctgaacattgaaagcacgccggccaaactgacgattgaccagacgagggcgtgggagaacttgaatctcaaatcatttgaaaagctgaacgctgaagccgcccaaaaaggtgcggaagcctgcagcgagtttattgccaaaacagtcagggaagggaaggaaatggcggctatcgaaaagaaaacgggcaatgtgatggcccggcaggcagcagatgtcagtccgcccgatccattcggcgaattcagcgactttctgcctgcgcagtttctcgtcgacattgactgcattccttcaaagcttacgattgatattgaagcccgcaaaccttcaattgaagcagccgtcaataaacctgtatggaattatacgccggggaaagttcagattgatatgatgcaagaccctaaggtgacgatttcggttgacgatggcaacgcagaataaaagatgaaagtggtaaaggattgtgaagcatgataattaaaacaaaatatcacggagaaatcagaatagacgaagggcagattatctcatttgaaaacggcctgccgggatttaatgacgagactcaatttgttgttcttcctttgtcggaagattcaccgtttttggcgctgcagtctgtgaaacaggagcatatcgcctttattgtcgccagtccgtttattttctttaaagggtacgaatttgacattgaccatgcgacgcttgagcttttgcatattgaagatatagaggacgtcgaagtgatggcgattttaacgctggaagagccttttgaaaacacgaccgccaatttaaaagcgccgattatcgtcaataaaaaggaaatgaaggcgaaacaaatcattttacatgatgcttcctatgaaacaaaacatctgataggaggaggatcatgctagttctctcaagaaaagtgaatgagtccattcagatcgggccggatattgaaataaaggtgatcgcaatcgaaggagagcaagtgaagctgggaattgaagcgcctcagcacgtagatattcatcggaaagaaatctacttgtcgatcctggaagagaacaacagagccgtatcttttaatactgatttattacttaacctatcctcacaaaaaaagtgaggatttttttattttcaatataaacaatagaagcggccatccgatatatatagtgtagccaatgagaggaaaaattttcttcagaatgacgctgcgcaaatgcacaaggacgtgcgaaaaacaattcagggaggaaatacaaaatgagaatcaaccacaatatcgcggctcttaacactagccgtcagctgaatgcaggttcaaactctgctgcaaaaaacatggaaaaattatcttcaggtcttcgcatcaaccgcgctggtgatgacgctgcgggtcttgcgatctctgaaaaaatgcgttctcaaatccgcggtttagacatggcttctaaaaacgctcaagacggaatctctcttatccaaacatctgagggtgcattgaacgaaactcacagcattcttcagcgtatgagcgagcttgctacacaagcggcaaacgatacaaacacagattctgaccgttctgagcttcaaaaagagatggatcaattatcatctgaagtaacaagaatctctactgacactgagttcaacacgaagaaacttcttgacggaactgcaaaagatcttacgttccaaatcggagctaacgaaggtcaaaccatgactttgtctatcaataaaatggactctgaaagcctgaatgttggtacgacttatacagctcaagctgatggaacacttaaatcaggtgatggaaatagcactgctacttgggcagatgaagaagtaacagacggtaaagttacaaaagaagctggttattatgatgataaaggtgctctagtaggaagtgaaaaactagaagaaggcgaaaagttatctaaaggtatcgacatctcttcttcagctaaagctgcgtcttcagctcttacaacaatcaaaacagctatcgacacagtatctagcgagcgcgctaaacttggtgcggttcaaaaccgtttagagcacacaatcaacaaccttggtacttcttctgagaacctgacttctgctgaatcacgtatccgtgacgtagacatggcttctgagatgatggagtacacgaaaaacaacatccttactcaggcttctcaagctatgcttgcgcaagctaaccaacagcctcagcaagttcttcaattgctgaaaggttaatgacggaaagatcctggttctccagggtcttttttttatttcttcagctatctcccccttcagcaagccaaagaaccctattgacaaaatgaaacgttataatttgcagttaaattattgaaaaccttataatctgaccgatataagaataagatcatacatttatggagctgtgatatgataaacagtcggaaactcactgttgtcatagagccgtctacgactaaacgccgaaaaggagagggtacatatggtcacaagaatcacaggccttaattccggtcttgatgtagattctctggtgaaaaaaatgatggatgccgaaaagcagccgcttaataaattaaaccagcaaaagcagacgcttgaatggaagcgcgatgcttatcgggaaatgaatacccagattgccgacatgtattctactacatttaataatatgctgatgtctacaaactggaataaaaaaacagtaacaagttcggattccagtgtcagcgcgacggccgtcagtgctgaacagaatatttcaacgagcatgtctgtacagcagctggctacgccgacgacttataaatcatcgggggccatcaatttcacttcgggtcagggccaaacattgaaattcaatgtcacaaatccgggtgaaacgaagccgactgaggtaaacgtcacgatcgccgcaaccgatacgattgacgatgtcatttccaaactgaacagctcgggtctcggagtgacggctttaaaagagaaaatttccaacggcacggattatgtggatacgattgcgttcacttccaataaaacgggggaaggatttacccttgccgcaggtgatgacgcaaccaaaagctttctgaaagatcagctcggttttgccgttgatgatgcaacaaatgaactgacggccaatgccgaagggaaaaacgcgaagtttacgttcaacgggcttgaaatgaccaaaacgtccaataactttacgatcaacggcatcaaatacacgctgaacagcgtgacggacagcaataaaacggttacgattaacagcacgactgatacggacggcatttttgacaacattaaagatttcgttgataaatacaatacgttaattaaaagtgtaaacgagaaggcgtcggaatcaaaataccgtgattataagccgctaaccgatgaacaaagagaagcgatgaccgataagcagattgagcagtgggaagcaaaggccaaaagcggtttattacggagcgacagcacgctgcagaacggtttggcggagatgcggcttgatctgtactcaacggttacgattgacgggaaaaaatatcagcttgcagatttcggaattgagacgtctgatagttatacggatcaaggaaagcttgtcattaaagacgaagcgaaactgaaacagaaaattaccgagaatcctgctctcgtggctaaactgtttaatgcagacagccctgatacagcgaaaaccaaaaacccggaggaacaggggattgcccggagattaaaagacacattaaacaaaatgcagactcaaatttcaaaacaggcgggtacggaaagctcggtatcaaccagctttgccatcggaaaaagcctgaatgaaatagaaacaaatatttccaatatgaaaacgaagctggatgatatcgaaacgagatattataaaaagttcagcgcactggatacggcattggagaaattgaacagccaatcttcatatctcacgtcaatgttaggatcttcaacatcataaccttggaggttttataaaaatggcaataaataatccttttgctgcttatcagcagacatccgtctttacagccgctccggaagagctgacccttatgctttataacggctgcctgcgattcattaagctggcaaggcaggcgatgaagcaaaacaaccttgaagccaaaaatgaaaatatcgtaaaggcgcaaaacatcattcaagagctcagcatcaccttaaaccgggagattgagatttccgagcagatgtcatccatttatgattacatccgccgccggctgatcgacgcgaacgtgcagaataacggagagtttttagatgaagcggaaaagctcgttactgaatttcgcgacacgtggaagcaggccatgcagagtgaacggaaaaacagccatggcgcgggcggccttgcctgatgaacagcaatgtctttgctttgtataacgaaacgaagaacatgtacgccgcgctgaaggacgccccggaaagcgacagtcttatcagcagcgttacggcatttacggagaaaagggaggagatgcttgcgggcataaagccgcctttttccgaagaagaaaaaacgctgcttcagcaggtggccgcgatggaccgcctgattaccggcgaagtgaaacggattcaggatggtatccgaaatgaaataaaaacgcttaagaaaaaacgaatctaccataatacgtatttcaatccgtatcatcaaacgacaagtgacggccgttattacgacaaacgcaaataggtgagtgttttgagaagtttgaacgattaccatttggtgtcagcctattaccagcttctttttacgattgatgaggggctttgctacctgttggacacgcaggatgatttttttaagacggagggcgagcggatttacaacgatttgattcaggctttttttcatctcgattcctctcatgcgcttctgctgtctatcattgagtgccgatgcgtggagacggcgatccgctcatttgacgacatctttcaggatttcagcatgttaaatgattatgatttcccgtccgccccttttcaggagtttttaaaaaccatctttctgccgcattataagctgtggatggagcagacgcacgactgcatcaaaccgtatgttcttcactagacctgctgcaagcggcaggtcttttgcctgcgtcctctgcatatacttataatcctgccggaagctgcgggataaaaccgacaccattcgtcatcgttcaccgaatttacacattattttaacgtttcagcagggatcagaaggggtaaaagagaaatagttacatatccttagataaagggaggcgttctttgatgaactacaatatcagaggagaaaacattgaggttacacctgcgttaaaggatcatgtggagagaaaaatcggcaagctggaacgatatttcgagcagagcgtcaatgccgatgtgaacgtcaacttgaaattctataatgataaggaatccaaagttgaagtcaccattccgatgactgatctggcgcttcgttccgaagtgcataacgaggatatgtacaatgcaattgatctcgcaacaaacaagctggaacgtcaaatccgaaagcacaaaacaaaagtcaaccgaaaattccgcgagcagggtcttccgaaacattatttcgagaacggcagcgctgctgatacgggcgtagcggttcaggacgaaattgaagatgacagcccggaaattgtccgtcaaaagcgttttaatttaaaaccgatggataatgaagaagcgattctccaaatgaatatgctcggacataatttcttcgtattcaccaacgcggagacgaatctcacaaatgtcgtttaccgcagaaatgacggcaaatacggattaattgaaccgactgaataaacccacccagccttccgtgaacgcgcggaaggtttttctctatctttatctgcaaattctttggaaatagcaaaaggtatgttatgataatgagaggtatacatggacagaaaattatcatttattccatgcaaaatctgcatgtgaacatagaggagcgttatagatgcttgggattttaaataaaatgtttgatccgaccaaacgtgcgctgaacaaatacgaaaaaatagcgaatgacattgatgctgtaaaaggagattatgaaaatctctctgacgatgcgcttaaacaaaaaacggcagaatttaaagagcggcttgaaaaaggagaaacgacggatgaccttcttgtcgaagcgtttgccgtcgttcgtgaagcttcccgccgcgtaaccggcatgttcccgtttaaagtgcagctgatggggggccttgcccttcatgaggggaatatcgcagaaatgaaaacaggggaagggaaaacgctgacgtccacccttccggtatatttaaacgcgttgacgggaaaaggcgttcacatcgtaacggtcaacgaatatctggcaagccgtgatgcccagcaaatgggagaaatttttgcgtttctcgggcttacagtcggcctgaatctgaattcgttgtcaaaagacgaaaaacgcgaagcttacgcggccgatatcacatattcaacgaataatgaactcggctttgattatttgcgtgacaacatggtgctttataaagaacaaatggtgcagcgcccgcttcattttgctgttattgatgaagtcgattccattttagtcgatgaagcgagaacgccattgattatttccggacaagctcagaagtccacaaaactgtacgtgcaggcaaatgcgtttgtccgcacactcaagcaagatcaggattatacgtatgacgtcaaaacgaagggcgttcagctgacggaagaaggaatgacgaaggctgaaaaaacgttcggcatcgacaacctgtttgatgtcaaaaacgtggcgttgaaccaccatatcaaccaggctttaaaagcccatgcggcgatgcagaaagacgtggattatgttgttgaggacggccaggtcgtcatcgtcgattccttcaccggccgtctgatgaaaggacgccgctacagcgaaggccttcaccaggcgattgaagcgaaagaaggcctggagattcaaaatgaaagcatgactctggcgacgattacgttccaaaactatttccgtatgtatgaaaagcttgccggcatgaccggtaccgcaaaaacggaagaggaagaattccgcaatatttataacatgcaggttgtgtccattccgaccaaccagccggtcatccgtgacgaccgtccggacttgatctaccgctcaatggaagggaaattcaaggcggtggcggaggatgtcgcccagcgctacatgaccggacagcccgttcttgtcggtacggttgccgttgaaacatctgaattgatttctaaacttctgaagaataaaggaattccgcatcaggtgctgaacgcgaaaaaccatgagcgtgaagctcagatcattgaagaagcgggacaaaaaggcgctgtcacaattgcgaccaacatggcaggacgcggaaccgacattaaactcggtgaaggcgtaaaagagcttggcggccttgcagtcgtcggtacggaacgccacgaatcccgccggattgacaaccagctccgcggacgttcagggcgtcagggagacccgggtatcacacaattttatctttcaatggaagatgaattgatgcgccgtttcggagctgaacggacgatggcgatgcttgaccggttcggtatggatgactccacgccgattcagagcaaaatggtgtcacgcgccgtggaatcgtctcaaaaacgtgtcgaaggaaacaacttcgattcacgtaaacagcttcttcaatatgacgacgtgctccgtcagcagcgcgaagtcatttacaagcagcgttttgaagtcattgactctgaaaacctgcgtgacattgtggaaggcatgatcaagtcttcactggagcgtgcaattgccgcttatacgccgaaagaggagcttccggaagaatggaatcttgacggcctcgtggagcttgtgaatacaacgtatcttgatgaaggcgcgcttgaaaagagcgatatcttcggaaaagaaccggatgaaatgcacgagatgatcatggatcgcatcatgacaaaatataatgaaaaagaagagaatttcggcacagagcagatgcgtgaattcgaaaaagtcatcgtcttgcgtgccgtcgattcaaaatggatggatcatattgatgcgatggatcagctgcgtcaagggattcaccttcgcgcctatgcgcagacaaatccgctgcgtgaataccaaatggaaggtttcgctatgtttgagcacatgattgagtccattgaggacgaggttgcgaaattcgtcatgaaggccgagattgaaagcaatctggaacgcgaagaagttgttcagggccaaacgacggctcaccagccgcaggacggcgatgaggccaaacaagcgaaaaaagcgccggtgcgcaaagtcgtagatatcggacgcaacgcgccttgccattgcggaagcggaaaaaaatataaaaattgctgcggccggacagaatagtcacgactgtatgcatcgaacatgaccgggtctgcgtcttatggcgccccggatcttttaatgaggtgaatggaatggaattatcagaaatcagggcagagctcgaaaatatggcttctcgtttagcggacttcagggggtctctttgacctcgaatcaaaggaagcccgcattgcagaattagatgaaaagatggcggaaccggaattctggaatgaccagcagaaggcccaaaccgtcatcaatgaagcgaacggtctgaaagaatacgtgaactcctatcatcagctgagcgagtctcacgaagagctgcaaatgacacatgatcttttaaaagaagaacctgaccaggaccttcagcaagagcttgaaaaagagctgaagtcattaacgaaggaattgaatgaatttgagcttcagctgctgctcagtgaaccatatgacaaaaataacgcgattttagaacttcatccgggggccggcggtacggaatcccaggactggggttccatgctgctcagaatgtatacccgctgggcggaaagacgcggtttcaaagttgaaacgcttgattatctcccgggagatgaagcaggaattaagtcagtcacactgcttattaaaggccacaatgcatacggctatttaaaagcggaaaaaggcgtacaccgcctcgtgcggatttctccatttgattcatcaggccgccgtcacacgtcattcgtgtcttgtgaagtcatgcctgaattcaatgaagaaatcgacattgatattcgtaccgaagatattaaagttgatacgtaccgggcgagcggtgccggcggacagcacgtcaatacgactgattcagccgttcggatcacccacctcccgacaaatgtagtcgtcacgtgccagacggaacgttcacaaatcaaaaaccgcgaccgggcgatgaaaatgctcaaagcgaagctgtatcagcgcagaattgaagaacagcaggcggagcttgacgaaatccgcggcgaacagaaagaaatcggctggggcagccaaatccgctcgtacgtcttccatccgtactccatggtgaaagatcaccgcaccaatacggaaatggggaacgtgcaggcggttatggacggagatatcgatatcttcattgacgcctatttacgttctaaactgtcgtaatccgggaacacacctgcctgtggcaaggtgtgtttttttatccgttctcttttccatttttcacaacagcgctttagcaaattaatacggtatttggctgttatttacttctaagccgggaagacttaaaatgctatcgagagaaaatcggagaacggaggattttgcatggatgtgaatcacaataagccgctccgtctgatcaaagattatatatacatcatgatcggcgcggcgattacggggatcgtgtttaacgtatttttgctgccgaaccgtatagcagcggggggagtaagcgggatcagcaccattttagaaacgtttggttttgaaccggcttacgtgcagtggattattaacatccctttgtttatcgccggagtgattattctcggcgggaagttcggaatgaagacactggtcggttccatcgttctgccgctcgccgtctatttgacaagagatctgcctgccgcgacgacccatgaactgctggcggcgattttcggaggcgtcgggatcggaacgggaatcggcatcgtgtatctcggcaaaggctccacggggggaacggctctggcggggcagatcattcacaaatacacggggctttcgctgggaacgtgccttgccatcatggacggattaattgtgctgagcgcgatgctcgttttcggagtggagcagggactgtatgcgatgctcggggtatttatttcaagcaaaacgattgatgtcgtgcaggtcgggttcaaccgttccaaaatggctttaatcattacgcagcatgaagaagccgtcagatcggctgtgtttaaagaaatcgacaggggtgtgacgaagatttccgcagtcggcgggtatacggaacatgaccggccgatcttaatgtgtgtcgtcggccagaccgaattcacaaaactgaaacaaatcgtcaaacaaattgatgagtcagcctttgttattgtcgcagacgcaagcgaggtgctcggcgagggtttcaaacgcgcgtaaacggggttataatagcgaaggggtgcatcttacatatgaaatcaaaatgggcgctgctggcgctggttctgaccatgtccgtcctgctggcggcatgcggcggatccaatgaatcgaaaaaagaaagctctgacagctcaggcggatcaaaagcttctgcgtcagcaggagaagagctttatcagcaaagctgtatcggctgtcacggaaaagacttagaaggcggcggaggcccgaatttacaggaagtcggcgggaagtatgatgaagctaaaattgaaagcatcattaaaaacggacgcggcaatatgccgagccatcttgtaaatgataaggaagccgctgagatcgcaaaatggctgtcacagaaaaaataacagaaaaaccttgcctgttataggggcaaggttttttcacggtctgggaatgaaaagaaactgtaatagtaatatgtctaaatttgacgtataatgaagtgtactgaggaaaaggaactttcagatttttcatctgtttcctgacgaatcggccataaaccgctatatgtttgcgaactctatggctgcaagacataaataaaagattaggtgatttcatgatagagatgaaagaagtatataaatcctatccgaacggtgtaaaagcgattaacgggctgtcagtcatgattcatcccggagaatttgtatatgtcgtaggatcgagcggagccggtaaatctacttttattaaaatgatttacagagaagaaaaaccgacaaaagggcaaatattgattaaccataaagatctcgcggctgtgaaagaaaaagagattcctttcgtgcggcgtaaaataggtgttgttttccaggatttcaaactccttccgaaattgacggtatttgaaaacgtagcgtttgcgcttgaggttatcggagagcagcagtcagtcattaaaaaacgcgtgctcgaagtgctcgatcttgtgcagctgaagcataaagcacggcagtttcccgaccagctttccggaggagaacagcagcgtgtttccatcgcaagatccatcgtcaacaatcctgacgtcgtgatagctgacgaaccgacgggcaaccttgatccggtaacatcatgggaagtgatgaagacactggaagagattaataaccgcggaacgaccgtcgtgatggcgacacacaataaagaaatagtaaacaccatgaagaaacgggtcatcgcgatcgaagacggaattattgtgcgtgatgagtcaagaggggagtatggttcttatgattaaaattctcgggcgccatttgcgtgagagttttaaatctctcggaagaaacacatggatgacatttgcatccatcagtgccgttaccgttacattgattttggtcggcgtgtttttagtcattatgctgaatttaaacaacatggctaaaaatgctgaaaaagaagtggaaattaaagtattaatcgatctgacgtccaataagaaaacgcaggatacgctgcagaatgagattaaagacatctcgggaattcaaagcgtagagttttcatctaaagataaagagcttgatcaattggtcaaaagcttcggcgacagcggaaaggccatgaaaatgcaagatcaggaaaacccgctgaacaacgcgtttatcgtcaaaacgacagatccgcatgatacgccgaaagtcgcgaaaaaaattgagaagcttgatcatgtgtataaagtgacatacgggaaagaagaagtcagccgtctgtttaagatcgtcggggtgtcacgcaacatcgggattgcgttaatcatcggccttctgttcacggcgatgttcttaatttcaaatacgattaaaatcacgattttcgccagaagaaaagagattgaaatcatgaagcttgtcggcgcgacaaactggtttatccgctggccgttcttcctggaagggctgctgctgggggtattcggttctatcataccgatcgctctcgtgctgagtacgtaccagtcgatggtcgcttgggtggccccgaaagttcagggctcatttgtttcacttctgccgtacagcccgtttgtgttccaagtatcacttgtgctcattctgatcggcgcggttatcggagtatggggaagtctgacttccatccggaaattccttcgtgtataaatacaaaagccagtctgatatagactggcttttttaaatggtttcgttactgaatgacgggcagggccggtgatccgggctttaatgtaaagtcataagacgattcgtcacggtacatcgggtccgcataaatggaatccgaatcgtttgccgttcctttttggtacgctgtgaatgaatcatattctctgttcttccaattccaaatgccgccttttcccgcttctttgtgatagacgttatgattaacggtattgccttcgtttttcgtataatcatttgcgataaaaatccgtgaaccgcttgccgtcatgatgtttttttcgatcgtgttcccttttgtgccgtactgcagcagcagctggccgccgtcaaggtccttcgtgtcatttcgatacataatgttatgagcgatcaccgaattgatggtgccgccgcgtttcgtgtcatagcctccgattgaaataccggtgtaagcattgccgtacaccttgttatccgtaatccggatatctcgcgcgtatttccctttatgttcggaagtggcttcaatgccgaggtcattgttgtaaacggtgttattcttaatgtccacatgttctgcgccgtcaacgtaaataccgcccgctgaatattcatctccgtaagcgggatttccgtaagaagagttatggctcaccgtattgttttcaatgacgccgtttcgtgcatagtcgttttgcttggacgttccttcgtatccgatcacgtcaatcccgatattgttattgtcccggatggtattgccggcaatcttaaatccgtcaacattcccgttcagcacgaccgcttcgcttgcgccgagcgtcagtttttcaaccgtattatttgtgatgctgacatccttcatggcgcctgtgccgtaaaatgcgatgccgtgtgcatttccctcatcagccgtggttttaatgtttcggatatggttgccgtcaatgttgatatgactgcttgatccggtgacgaagattcccatggccgttgcatcttctgatgatacggagagattctcaagcgtaacgccgtgaatggtaatgtactctttattgcggatttgaattaacggagtttcagaatcgctttttggcgcagatttgccgctgattgagacatgctcattctgatagttccgaaatgtaatcggcttttcggccgtgccgctgtgctttacttcaaacgtttcatcgtacgtcccttcccgaatcaatacggttgtcccggcctctgccttttcagccgcatgttttaatgtgcggaacggcttttctttcgttccttcattttggtcgctgcctgccggagaaacatacagggcgtccgtctgcattttttcattggcctctgtttttggccagacaaaggcggtaatgcctgcggccagaaccgccgcggataaaatcgataattttattttcatttcgcattctcctgtatatttaatgaattgcatacaaaatattatacgttacccatatatatgaaacaatctcgcgttttcatttttttgttgccgttacatgaattctttgcaatttacacatactatctccaggttttcgtaaaaggactaagaggaggtaaacgatgaagcagaaaatgatcgcagtgatagcggccgtcagcatcatgtgcggcggagcccatattgccggggcggcacagccgaattcatcagacgcagaaagaagccgggcaatggaaaaaatcgaaaaagcatatgagctgatctcgaacgaatacgtggaaaatgtagataacgaaaagcttcttgaaggagcgattcaggggatgctgtctacattaaacgacccttattccgtttatatggacaagcagacagctaagcagttttccgattctcttgattcttctttcgaagggatcggcgctgaagtcggtatgaaagacaataaaatcattatcgtatcaccgtttaagcaatctccggcggaaaaagcgggactcaagccgaatgatgaaatcatcagcataaacggcgagtcaatgaacgggaaaggtttaaacgaagccgtgctgaaaatcagaggaaaaaaaggatcgaaggtttctattaaaatacagcgtccgggtactgataaacagctgtcattccggattaagagagcggaaatcccgcttgaaaccgtatttgcttcccgcaaagaatcaggcggtcatcatgtcggctacatcggcatatcgacattttccgagcataccgcccaggacttcgccgcggcgctgaaaaagcttgaaaaacaagggattgacggtctcgtccttgatgtaagagggaatcccggcggctaccttcaaagcgtcgaacaaattttaaagcatttcatcacaaaagacatgccgtatatccaaattgcggagcgtaacggcgataaaaaacaatatttctcaaccttaaaacataagaagccgtatcccgtcaatattataacagataaaggaagcgcctccgcttcagaaattcttgcgggcgcgttaaaagaagcgggacattatgacgttgtcggtgacacttctttcggtaaaggaacggttcagcaggccgtgcctatgggagacgggagcaacattaaattgacgctttacaaatggctgacaccgaaaggcaattggattcacaaaaaaggcattgctccgacaatcgccgtgagccagccggattattttgcggcgggaccgcttcagctgaaacggccgcttcagcctgatatgaacagcgcggatgtcaaacacgcccaaatcctgctgaaaggcctaggcttcgacccgggcagagcggacggctatttcagcaaaacaatgaaaaaagccgttctggcgtttcaagaccggtacaagcttgataaaacagcagtcattgataaaaagacagcggaaaaaatgaatcagctgatgaatgagaagaaatctgacgaaaaaaatgatttgcagctgcaaatggcgttaaaatcattatttgtaaaataaatgaaaaggaggcgttttttgcgtctcctatttcttttgtcattcgtaaaaaatgaaccaaaagacatataattatgacggttttgacaagatattaaaaaaattttcacatttaaacatttataaaggacaaacattacccgatatttatagagaagagagactttatgccgagttaatatgtattcaaaatgaaacttttgaaagttgcctcagtcagttttagttcttacaataaaagaaggttctaatagagaacagttttagtttggcagctgcatttcagtatcgaaagcagaagtgtttgcggcgcttcagcacggcagctgtaatcacccgtgcttatctggataaaaaaatgggggttcacaattgaagagggcaagtattgtgcgtgaaaaaaaatattatgaattagtggaacaactaaaagacagaacaaaagacgttacattttcatcaacaaaagcactaagtcttcttatgctgttcagcagatacctggtcaattacacaaatgttgaatgcgttcacgaaatcaatgaagagtgtgcgaagcattatttcacttacttaatgaaaaaccataaacgtttaggaatcaatctgacggatattaagcggtccatgcttctgatcagcggcgtgatcgaggtggaggttgaccactatctgaaagatttctctctctcaaatgtaacgctgtggatgacggaagagagatagacgtttgagatattcaagccaatgattatttggtagaatagaattaaaatgtttggcttgaggcggtgaaagcagtgtctgttcaatggggaattgaacttctgaaaagtatcggtctgttttttttgcacccgatgttctggttttttatcatcataagtctcgcatgcggatatttgcggatcaaacgtgaacgccatacgtttcatacaaaaatcgcggatatgtatgacgagcttatctttacatacataaaaggacttataccgggtattcttctctccatattattttttggactgggaatttcgattccattcggtcttctcggcataatcgcggccgtgacggctttggcttcgctgacgttccgtatgaattggctgtcctcagcttatattgtcagcgccggcatgttcattgcgtttatccttcagtatacccacacagtgccgtttgcggatcggtttccgcaggcattcggtgtgaattgggcgtcggcggccgtgtttatgggccttttgattatcacggagggagcggctgcctgccgttcagcgcatctgaaaacatctccggcgcttgtcgtcagcagcagaggcctgcccatcggccgacaattggcgaatcgcgcatggctgcttccgcttttcttattggtgccgggcagcgggcttgagtcccacctttcttggtggcctgtctttaccgtgccgggcggctctttccatttgatctggattccttatatcgccggcttcggacagcgtgtgcaggggtcacttccggaagtcagcataaggataacggcgaaacgtgtcatgattctcgggattatcgtggccgtattcggggcagcggccctttggtggactccgcttgccggagctgccgcttgtattgcggtgctcggacgcctgtttttatcattgagacagcggctgaacgataacgcggctccgttttatttctctaagcgggatcagggcttaatggtgctcggcatcattccgaacacacccgcggacgatcttgagctgaagatcggtgagattattacgaaagtaaacggcatccccgtgaagcatgtatcggatttttatgaagcacttcaaaaaaaccgcgcatttgtaaaaatggagatcatcggcctgaacggtgagatccggtttgatcagcgcgcgtcctatgaaggcgaacatcatgaattaggtattttattcgtgcaggatgaacacgagcacgaagaaatgacagcattataatgtgatttttcataattattcggaatagtttcaagaactcctaaactagatttcaaaatcagctagaaagtaaaacagctaagaaaattatattttcttagctgttttattttgaaataataaaaaaataaatgaaggagaggtatggcttattggaaaggttattgctaactccaaaacctttagaagatgaatctttagcaggatatatattaagaataactgattataatcgttatgttggataggaggagtacattataaaaaagcttttacttaagagattgccgttgatctcacttggagttatagcttatatactgacaaaatacacgcagaaccatcaggattgggcggagaaatacagtaggtctgtatatccgttattgtcaaaaacagtaggacttgtaccttcttgggtcacattttctgttagtgaatggctcgtagtgttggttgtgttactatttctattttatatcgtttattatgtgcgcaaggtcatcatgagtaaaggtgcacgtaggatggtagtttatcgtggtgctctaggaatcgttacgatctgtagcgtgatatatttttgttatactattttgggtggaataaactattacagatattcttttttgtcttataccgaatataaagaagagaactacagcaaggaggaactggtcaaattgagtaagtcacttgccgttgaaatggaattggcaagggaaaagttagcggatactgatcttttggctcatgtaccagaggtttttgattattatgcacaacacgcagtgttctcgatgcaaatgttatcaaagaaatatcctgttttggagcattcatattcaacaccaaaaccagtggtgatgtcaaaactaatgtcgcatgcagggatacatggtatttttgtcccttttacttatgaatccaatatcaatgttaatgtgccagtttttttggtgcctgctactatggcgcatgaattggcacatcagagtggtttcatgcatgaggatgaggctaattttatagcttatctggcatgtaagcagcaggatgatccaatgatactatacagtggtttatttctggcatttgattattctatatctgagctaaagaaagtggatccagataaggcgtctgatataatgtccagtctgtccaaagcggtgcggcatgatatagaacaaaatgagcagtaccgggataagtatgagggtgttatttcaagtatttcaagaaatgtaaatgacgtatatctgaaggcaaataatcagacagacggtttgaatagctatagtgatatggtgaatttattgctggcagagcagcgagagatagagaagtacaattaaatgtatcttgaatacttataggtttatatagtaatgatagtgggctcaagttgaacataggagtgagtgaaataaataaaataaaagtatttcctattccatatgctggagcgtcggtaaatgcatattatgaatggaaaaaactactgccggatagatatgaattgtgtatatgtgaattggctggaagaggaactcgattcacagagccttgttaccagtctgttggtgaagcaagtgaagatatcgccaaaagaataagtgaacaattagaatatgacgatgaatatgttatatttggacacagcatgggagccttattgacttatgagatatattataaacttaagcaaatgggaactaaggaaccaaggcatctgtttttttctgggcgagatgctccacatatttttgaaaagagagaagacattgaaaatatgactaatgaaactttcttgacaaaggtggaacaatatgggggaataccagaggagttttatacaaaagagattatggatatgtttcttccgattttgcgagcagattttataattttggacaattataagtttcagcccaaagcagaaaaaataagttgtggagtaagcgttttttatgcggatagcgatttttcgactcatatcaatgaaatgcataaatggagtgaagttgttgaaggaaacgtgaaatttcataagtttaaaggagaacatttttttttaaatcggtatcctaatgatattgtaaatactattgttaaagatacagagacttattcttgttcatgagagattcctcgtttcgtcaatgttggtgtggtaacttacattgtacaagaggaatctctctttcgcattcattttttggtagaatttagataatcgacagacgtgttattatataaatctaaaaagattttggtttagactttcttgtcccaatcaagttccaaaaataaaaatttagactttcttttctttgtacagtttgaatgtgttttgaaatattatatttaaaataaattttatcagtctgagaatccttcaatgattgttacttaattttgcttaattataaaagtaatattcaataattgttttaggtaggttttagtaaggagaattatggaaaaaattaagaaaaaacattggaaataataagctttcagttttaagcccggtgccgctaacaacacggcggccgggcttttttcacggccggattacggcgcaagcggccgaacttgatctgagctcttagcgatttacatttcccttttctcttttaaataaaaagattctaaaactagaaaaggttccggaaagcagatgcttacggaacctttttcgttatgccgaatggctttttttcgtctgaacggtttccctggacttgataccaagtgatacgaacaagccgatcacagaaactccgatcaatatgataaacagaatatgaaacccggagattaaaccgatcagcgctgaagaaataatgcttccgaaataacggaaggtggagaaaatcccggatgcgatgccggacatgcccggttctaccgtcgcaagagaagatacctgcatgctcgtcagccccgcacctgacgcgatgcctccgacaataagcgatgccataagaaacggaacggaatgggaataaaccaaaagcagaaataagagattggctacagccatcagcccgaaggacagaaaaatcattcttcgcgcgccccatttctgatgcagctgagctccgccccagttgctggcggacatgaaaacagaaaagactgacagcgccatgccgctgtgcgacgtattcatgctgaagtggccggtcataaagagcggcataatcaataacacggcgtacatcattaaattgcttaacagaaccgacagattggcgctcgtaaaggtcgtatttttaaacagatcaaaatcaataatcggatgtttcgtgcgcagctcccgcctgaaaaatagcggaacaaatacgagaatgagcagcgcgtacacccaatagcccaaagagctttcatttttcgtcagaagaattatagatacaatgcttccggcaagcaaaacggacccgatgatatcaagcggagcgtcagacgtttcttctttatatttaggaaacatcactaatgccgtcacgagtgcgatcgcaagaaacggaatgttgacccaaaagatcgaatgccagctgaagctctcaattaaaagagagccgataaacggaccgagagccgcgcccagcccggcaccgaggccgaaaaagccgaatactttcggaagccgtttttcagacacgacatggcggatgatggcgatgctgtttggcgtaagcaaagcgccgccggcagcctgaagcgcccggaagaaaatcaataagaaaagacttggcgagagggcgcaccccaatgatgcgatgagaaaaaggccgacaccccataaatacatttttttgtttccgtacatatcaccgagtttgccggcaatgggttgtgtcacggccatcacgattaaatacacggtcactacccatgtgatgctggcaattgattcgctgaatgagcgggaaatggacgaaagggcgactgcgatcatcgtagaattgatgggaacgagtatggctcccagcaaaagcgaaacgatcagcgcccattctttctttgaacccatccttcatcctccttggagccggaaagtgaccggccggtaatgcctttcatgaaaatctcagtgctgtgtttcagcatcgtttcctcagagagagtaatgactcttttccccagctgcagccggtgtataaaataaccgaaaatcatcgtcataaagacgtctgcattagcttcttcgctgccggggcttatcatatttttctttgtcagctccttaaagtaaacgattaaatgctttttcacggattgcggatatacgacaatatcctgcaggacgtcttcgaatagttccggttcgcgcaggcagatgcggaacacttcttttttttgttccaattgttgcagaagggtcgtggcgaaatgaagaagatcctcatacagatcgccttccgccttggtgatcatgctttccggagccggcgtctgctgttcaatcatggctttcattaatccttgtttgtttttaaaattacggaaaatcgttgcttcgcttacttttgctttttctgcgatttcttttgttgtcgctgcgcggtatcctttttggatgatcagattcatcgcggcgtcaataattctcttgttcgtcgttctcaacatgtttcacctcgcgtaaatactggcaggacaagtatacacccgccctgcccgtcaataaagagggaaacctagcatgaagcgcgtttgacaatcgtaatcttgccgtttgtcccgtccaccgtgacgatatctccgtcgttgagcctgtcagtcgcggcacgtgtgccgagaacggccgggagcccgtattctctcgcgatgatcgccgcatgtgacaggatgccgcccgtgtccgtaatgacggcctttgcatcctggaacagactggtccacagcggtgtcgtcattttgcagacaagcacgtctcctgttgaaaaacgggaaaattcacttgcgtcacgaatgactttcaccgggccgcttgcgattccgcttgacgccgcaagtccgtaaatttgatgttcagtgtttttttcatcttctgtgatggagccggtaatctgttcagccgttttcagctgttccgaagtcggagtcccgagataagcgggggcttcaagcaattgatattgctggaagagctgttttcgttcagcggctttttcctgcatcggaaccggcgacaccagcgctttctcgacttcatcgctgtataagtaccacatatcctcccgatcatcgattacgccttgtttttgaagcagctcgccgattttcagaaggcaaaggcgcgctttggcgtccagcatcgcatcaatataaaaatggtgatcatctttgatgacggatgaagacaatgtccactgataatagcggtcaaacgtctcccggaagccgtcatcttcaattctatccataaagtcggcgtagagctgttttcgtttttctatcgttttatgaaactcactgtcaaaatcgtatccgttccggacatagttctgaatgttggccaaagcgaaataagggttttccgcccaagtttcttcaatgagatcatggcttttcacggatctccagccgtattcctgtaaaaattgaccgacttgttcgagaaagcgttttccctcatttgattgcagaagcgtctgatgcagctcatcggcatgagaaaccgtaaagacgcgccgcagctcagggctgtcttttacttgtccggaaagcagccagagctgtctgtcggtctccaatgacttattcatgacgccagccagcatttcgtacagaagggaggtgttttctttctcaacctgtccgtacatggattccagtatcatgtttaacgcaacctgcggaaagacaatattgaaatgttctgcgtatccttttaaatagaagtcttgcaggtttcggaacgcatcaagggcagtctccggcgtatggtctgtatgcgccagttcgtccagcttttgataaaaaggcagaaaggtttcctgaataatatcgtacatgcggtcagccaagacggggaaaagcgcttctaattgttctgcgggcagcttgtcgtccgtcttatgctgtctggaaaaaacacggccctgatgaagtttgacacgctcgatttcgatgcccattactgggaatgcctttgtgctctctttgaggccgtattccaaagccggcacaatgagtgaggcgaataacgggctgacggggccttcaatattggcctccatattgagccaaaaatctttctgatcccggggcgtcatgataaattcccgttcttcgtctgccgctttctgatcctgcgcgattgttgtaatcggcctggcctgaagcagatacagcttattttcggcaaatccgaattcgagatccacgggataaccgtacagttcttccgtctttatcgtcagcatggcaagctctttgacgctctcgtcatcaaggcagaagcggtttctcatgtcagcggtcgtctctttttccgtcacgccttcgtctttagaaacgatatacatttcttttaagccgatttctttttcaatctgaaatgtgtctttattgacgataaatgtgtcgggcgtcacgctgccggagacgattgcttctccgagaccgtagctcgcgctgatcatcagctctccgtcatcatgtgtgacggggttgcggctgaaaatgactcctgaaacctcggaattgatgagaccttgcacgacaacgcccattaacggttctgcggtgtcattgttcattttctctttataaccgctgacccgcgccgagaagaaggaagcccagcattctttcacttttccgagaaactcttcttctgttttgatatttaaataggtttcgtactggccagcgaaagaagcgccttcaagatcttcagacgcggaggaggaacgtacggcgacagaggcgtatgtttctctcaattcataaaacaacgcggtcagttcctcccgaagctcttttgaaaacgtgccgttcataatggcgcgctccatctgttcctgatctgcttgaagcccgttgtcttccataaaacgtgtcagggcattcgtctgaatgatgaaaccgccgggaacgggcagcccgtttttcgtcagtttaatcaggttcattccttttgctcctgcagagcggctcgattcttccgctttttgaaatcgcactgaatacatgcggtatgacccccttttttttcctcatccaagaaaatgatagtaaacactatcattacattgtaaagagggaggaagaaactgtcaaagatacaaagacctaaaccttctcatcctttcggctgaagaaaggtaattcgattcatctggttaatggttcaatggatttatattcacaatttttttgacagatgattgaagactgctgaaaaagggtattgtgatagcaggggaatgattgtccgattcttcattttttactataatcagatgagatgaagaattcccgaggagggtttttgtgattacaaaagccgtttttgcattatgtttcccttttatgctggtcgtcctttttacgcgcgtcacgtttaaccactatgtggcgatcgctctcacagccgcactgcttttcgcatcctatttaaagggttacaccgaaacgtattttatcgttggattggatgtcgtatcgctggtggccggagggctgtacatggccaaaaaagaagcagacaaaaagaaagacaatgcctgacatggtgaatatgaaatagaatgcctgcttttacgccataaaagcaggttttttatacaaaaattgacttggtaaaaacaaaccatcgaactttagttcgtattttagtgattttgcccgtcattgtgttactatatcaataggaagatttcgtaaagaaacggaggcttttttgtgaaagatcgttttgagttagtctcgaaatatcagccccagggagatcagccgcaagcgattgagaagcttgtcaaaggcatacaggaaggcagaaaacaccagactctcctgggtgcgacagggacgggcaaaacctttaccgtgtccaatctgattaaagaagtgaataaaccgacactggtcattgcccataacaaaacccttgccggacagctgtacagcgagtttaaggagtttttcccgaacaacgctgtcgaatattttgtcagctattacgattactatcagccggaggcgtacgtgcctcaaacggatacttttatagagaaagacgcaagcattaatgatgaaattgataaactgagacactccgcgacatcctctctgtttgaacggagagatgtcattattatcgcgagtgtgtcatgcatatacggtctcggttcgcctgaagaataccgggaaatggttgtgtcgctcagaccggaaatggagattgagcggaacgagctgctgagaaagcttgtggatatccagtatgcccgcaatgatatcgactttcagcgcgggacgttccgcgtgcgcggagacgttgtggaaatcttcccggcttcccgtgacgaacattgtatcagagtggaatttttcggagatgaaattgagcggatcagagaggtcgacgctttgaccggagaaattctcggcgaccgtgaccatgtcgcgattttcccggcttcccacttcgtcacccgggcggaaaagatggaaaaagcgattctgaatattgaacaggagcttgaggagcgcttgaaagtgatgcacgaaaacggcaagctccttgaagcgcagcggcttgagcagcggacgagatatgatcttgaaatgatgcgggaaatgggtttttgctcagggatcgagaactattcaagacatttgacgctccgaccgccgggctctacgccgtatacgctgcttgattattttccggatgattttatgattgtcgttgatgaatcacatgtgacgattccgcaggtgcgcggcatgttcaacggtgaccaggcgagaaaacaggtgcttgtcgatcacgggttccgcctgccgtcagcgcttgacaaccgtccgctccgattcgaggaatttgagaaacatatgcacaatatcgtgtacgtgtcggcgactccgggaccgtatgaaattgagcatacgccggaaatgatcgagcagatcatcagaccgacgggactcctcgatcctctcattgacgtccgtccgatcgaaggacagattgatgatctgatcggcgagattcaggcgaggattgaacggaatgaacgcgttctcgtgacgactttaacgaaaaaaatgtcagaggatctgaccgattacctcaaggaaatcggcatcaaggtcaattatctgcattccgagattaagacgcttgaacggattgaaatcatccgtgacctccgcctcggaaaacatgatgtgttaatcggcatcaacctgctgagggaagggcttgatattccggaagtgtcacttgtcgccattctcgatgcggataaagaaggcttcctccgttctgaacgttcgctgattcagacgatcggacgggcggccagaaacgcggaaggccgcgtcatcatgtatgccgataaaatcacgaattcgatggaaatcgcgattaatgaaacgaagcgccgccgggaacagcaggagcgctttaacgaaattcacggcattacgccgcaaacgatcaataaggaaatccgcgatgtgatccgcgcgacgcaggccgctgaggataaagaagaatataaaacaaaagccgcgcctaaactggcgaagatgacgaagaaagaacgccagaaagtcgttgagcaaatggagcacgaaatgaaagaagcggccagagcgcttgatttcgagcgggcggcagagcttcgtgatttactgttagagcttaaagcggaaggatgatgaacacatggcaattgaccggatcgaggtgaaaggcgcaagggcgcacaatttaaaaaacattgatgtaacgattccccgggatcagctcgtcgtcgtgacgggcctgtccggatcgggaaaatcatcccttgcctttgacaccatttacgcggaaggacagaggcggtatgttgaatcgctttctgcctatgcgcgccaatttttagggcagatggataagccggacgttgatgcgatcgaagggctttctccggcgatcagcattgaccagaaaacaacaagccgcaatccgcggtcaaccgtcggaacggtaacggagatttatgattatctccggctgctgtacgcgagggtcgggaagccgcactgcccggagcacggcattgaaattacgtcgcaaacgattgaacagatggttgaccggattcttgaatatccggagcggacgaagcttcaagtgcttgcgccgatcatctcaggcagaaaaggcgcccatgtcaaagtgcttgaccaaatcagaaagcaaggttacgtaagggtgcggattgacggagaaatggccgagctttccgacgatattgaacttgaaaaaaacaaaaagcattccattgaagtagtcattgaccggattgtcgtcaaggaaggggttgccgcccggctttccgactcactggaaaccgcgctccgcttaggggaaggccgtgtcatgatagatatcatcggtcaggaggagctgatgttcagcgagcatcatgcctgtccgctgtgcggtttttctatcggagagcttgaaccccggctgttttcgtttaacagcccgttcggcgcctgcccgacttgtgacggtctcggcttgaagctggaagtggaccctgagctcgtcattcccaatcctgagctgtcattaaaagaacacgccatcgcgccgtggacgccgatcagttcacaatattatccgcagctgcttcaggcggtctgccgccattacggcattgatatggagactccggtcaaagacctgctgaagcatcagcttgataaagtgctgtacggcagcggcgatgaacggatctactttaaatacgagaatgatttcggacaagtgcgcgaaaatgaaattgaatttgaaggtgtgctgcgcaatatcgagagacggtataaggagacaagctccgattatatccgtgaacagatggagcagtacatgtcacagaagccgtgcccgacgtgcaaaggctaccggctgaagaaagaagcgcttgccgttttggtcaacgggcgccatatcgggaccattaccgagctttccgtcggcgatgcgctggaatttttcaaaaacctgacgctgtctgagaaagatatgcagattgccgatttaattttaagagagattgtggagcggctcagcttcttagataaagtcggtcttgattacctgacgctgagccgggcggcgggaacgctgtcaggcggagaagcccagcgcatcaggcttgcgacgcagatcggctcccgtttgtcaggcgtcctgtacattcttgatgagccgtccatcggccttcaccagcgtgacaatgaccgtctgatcagcgcgctgaaaaacatgagggatctcggcaacacactgattgtcgtggagcatgatgaagatacgatgatggctgccgattatttgatagatatcggtccgggtgccggcattcacggcggccgcgtcatatcggcggggacgcctgaagaagtgatgaatgatgcggactctctgaccggacgctatttgtcaggggctcaattcatcccgatgcctccggagagaagaaagcctgacggccggttcattgaaattaagggcgcttcagaaaataacctgaaaaaagcgaacgccaaattcccgctcggcacttttacggcggtgacaggtgtgtccggttccggaaaaagcacgcttgtgaatgaaattctgcataaggcgcttgcgcaaaagcttcataaagccaaagcgaaaccgggaagccataaagaaatcaaaggccttgaccaccttgataaggtgatcgacatcgaccaggcgccgatcggccggacaccgagatcaaacccggcaacttacacgggcgtgtttgatgatatccgcgatgtattcgcgcagacaaatgaagcaaaggtgcgcggctataaaaaaggccggttcagctttaatgtaaaaggcgggcgctgtgaggcctgccgcggcgacggcatcattaaaattgagatgcacttccttcctgacgtgtacgttccgtgtgaagtgtgccacggcaaacgttacaaccgggagacgctggaggtcacatacaaaggaaaaagcatttctgacgttctggatatgacggtggaagatgctctgtctttctttgaaaatatcccgaaaatcaaacgcaagcttcaaacgcttgccgatgtcggactcgggtatgtgacgctcggccagccggcgacgacgctgtcaggcggagaagcgcagcgcgtcaagcttgcttccgagctccataagcgttccaccggccggacgctgtatattttggacgaaccgacgacaggcctccacgttgatgatatcgcaaggcttttggttgtgcttcaaagactcgtcgataacggagataccgttttggtcattgaacataatctcgatatcattaaaacggcggactacatcgtcgatctgggacctgaaggcggagcgggcggcggcacgattgtagcctccgggacgcctgaagaagttgtcgaagtgaaagaatcatatacaggccgctatctgaaaccggtaatggaacgtgatagaaaacggatgaaaacattgctggccgaaaaagaaacggcagccacgtaatagatcaataaaaacagcccaaaactcatcggttttgggctgttgttgttacaggctttttttctgttggggaagctgtctgcttaaatgcattaagtcctgcagaatatgggtgctgctgctgtccagcagcacttttatatattggatatcatgggaaatgggaagaggggctgctttgatctgttccaattcagccagcatttcgctgttcattcttttctgttcgcgaattaaatttcgaagactctcttccgttacttgggcgttttcgggatctttctccatttgtatgtcctccttgcatacggtcaggctttgttacatattgtaatcggttcggggaaaagattctatagtgaaatctctgaaatcaaaaattacgtataacgaagcatgtccttagcatgaaaatgaaacccgcccattcgtcatacgtatgtataaggaagggtttttacattacggcacagggagtgtttttattgaaccgaaatcaagcgattatcgcatcaatctgttatttcagcgtgtttctcgcgccgctcattcttccgattgtggcttactttgtcgtcgatgaaaaagagacgaagcggcatgccatgcgcgctctgatttcccatatcattccgtttgcgggattgctgattgtgaccgcgggtgttgtcggcggattgattacggctcaaggggagagtatggtgcccgtttttgttatgataacaggagcagctgtttattttctgatcctcatcggaatggtcatttggaatatcgtgcagggaattaaggtgttacgccaggtgtaagaaaagtcgggggaggagttttgtatgaaacaggagaaagaacggattttaaagcttgtggaagacggcatgctgacggcgcaggaagcactgacgctcattgaaaaactggatcatgaatataaagaaaaagaagagcagatcaccgcattatctgcggaggtccaggaacctgcggaagatttcgaaagcggggcaaaaggaagccaaaagccgtcgctcggggcgaagctgttcgactggattgattctgccgtcaaaaaagtgaaggaagcggatcttgatctgaatttcggccacgcacacgaagtgcagcatatttttcaatttaaagacagtgaattctcggccattgatatgcagatcgcaaacggcagcgtcaatatcgtgccgtgggcggatgaagatatcagagcggagtgccaggcgaaagtgtaccgggcggacagtcaggaggcggcgcgcaccgcatttcttcagcacattgagtgtgaagtgaagggcaataagttttttgtccgcacggaaaagaaaacgatgaaaaccaatgtcacgctttatgttccccagaaagagtacgataagataagagtgaagctgtttaacggaccgatcagaggggaacatttacatgtaaaagaattctcggcgaaaacgacaaacggcgttctgtcattttctcatttgacggctgataaagcgtcggcggaaacagctaacggacaaatcaaactggccggacatcaatgcggagcgattgaagcggaaacgatcaacggcttgattgatttgcgcggatcgagtgaatccattgacgttcaaagctttaacggcaatatcatgcttaccgtgacagcgccgcactgccgctccatctacacgaaaacgacgaccggaaacgtggagatcgctctgcctgatgattcggcggtgaaagcggagctgaaaagcaatctcggctctctcagccatgagctgattgatgcggaaattttaaaggaaaagaatgacaccattcaaaaagaactgatgctggcatcaaatcaaggccatgatcagcatctctcgattttctcagaatcgttaacaggagccattaagctcaagcatactcagaggtgattggatgaaaagactttaccgttcagaaaaaaatcgtaaaattgccggcgtcgtcggcggtttggcggagtacatcaatatggatgcgtcgcttttgcgcattatcaccgttgtattagcgcttgtcatgccgggaatcgtgccgattgtatatattatctggtgttttgttgtacctttagaaggagatttgaaataaatgatcaaatgggcagtcagcattttagtaaatgcgttattattaatcgttatcgcgggatattttgattccgtccatatcagcagtatcggagcggctgtcatcgccagtgtgattctttctgtgttaaatgtgctgatcaagccgatcatcattatattgacattgcccgtcacggttgtaaccctcggcctctttctgtttgtcatcaacgccatcacgctgatgatgaccgctgccttgatgggagacagctttcagattgacgggttcggcaccgccatttgggcatccgtcgtgctgtccgttttccacttgctgattcaaaaaggcatattggagccgcttagaaaaagataaaaaaagaagctgtccccaaggggggcagcttttttatgtgcggtacataagcggccgcctcctgacgcaacataatgcatagggaggtaatgagatgaaacttgtgatgacgctcttttttctgatttgtttgctttgtgtaagtccttctgcggatgcggcgcgcaaagaaccggcaatccccgtgaatcagcaggaattcggacagccgcctcattacataccgcttctggagaatcctccccaaatcgaagtaaaggcggaaatgaaaagaaacctgttcatacaggctcatgtacggaatgctgactatcaagcgttttcggcgtttcttttttataaacaaagcaatgagctggggtttaaaatggtgccgatggagcccgcgccaggcgcaatccggctgtttacggcccaggtttcaaaacgggatatctggaatggagaattggaatattacctcgttttcaccaacggcagacagcgggcggaatcggagaaaaagcggctgaagctggacggctatcaagccgatttgaatcatattcccgagctgatgattacggagcttgcggttgatacgaaaaatgaagacggcgctgatgcctatgaatttatcgaggtgtataacacgacggacaggcccattcattttaaagactatcacatccgctaccgctatccgaaggaagggccggaatcagatatgatatggaggccgaaagaagataccgtcattccgtcaggcgggacttacgtgttttggctgagacgcgccgcatcagaactgacgatagatgatttcaaccgctattacgggacacgcctgaaggagggaaaacatctcgccgtcatcgaagggacggacggaatgtccaacgaccggccgaggacggtggtgctgtcggcaaataccggaaaaaccatcgcctcagcgcactatcgaaaacacgcgttccgccggctgacttctttgctttataaatatccgctgaacggaacgggagaattgctgaagatttccacgagcgaacataagccgtcaccgggctctgtttttcaggcgcagatcccggagcagaaaagggtgataaaacccgacaaggaaaaaccggtcatcgaagaccttacagacagaaagcccgtccggcccgctgaaagcattgaattaaaggctgacataaaagacaaaaaccttgtcaaaacagccgcgttttattaccggaccaatgagaaaaaaccatttaaacgaattctggctgaaaaagaccgcaacgacaggttatatcgtcacattctttattccccggaactgctcggccaggatcagcttgagtattacatcgcagccggtgacggagaaaatgaagcaaaaacgcccgtcaagatgattgacattaaacagacgagcaaatcacacggactcaggatgaacattgaacccgaagatacgatatccggcacctatctcctcaaagcgacatccgacgtcagcgctgataagatcaagctgtggattgacggcaagctgcaggagacccggcctgcgctggaaaaagaagtttacttcgctttcgatgcccggaaaacgaatctttatttccaaaacaccgtcatgatggaaaacgaggtgctgcacatttttgacgatccggcacaccgctacagaacgtactcggtgctgctgccggaacgtctgctgcaaaaagggggcaaaacacagaaagtctccatccgttcgggctccaaggtttctccgtatgacataggggagaatcgggatgattttatcgtgaaaaatgcccgcctggtgctttcagacggaacggtgatcaaaaacggggagcgggatccggctgagcagctgtttatcggtgacggcaagcgggcgaatcagcgcatgaccttctcattcagcctgccggatcatttgtttacgtcgcggcttctgccatggaatacggtgaagctttctgaagggcatcaccacatttttgtgagcgacggtgaagagcagctcagtcagtctgtgctggtggacaatacggggccgaagattgttccgggaatcaaagaaggcgcgacactgaaaggtaactttgagctgaaagcggacatccgtgataaatggagcaaagtagaagaagtgaaagcgtttttggacggagaaagcatcacgctcccgcatcatacgtcatcagccgatcttaagcccggaaagcacacccttaccatcactgcggcagaccttgcgggaaatgaaacaacatccgtccgcaccttccacatcaaacgggaggagccgaatcagccggagtttaccggccaaaaaaccggcgcccataaagcgaagctgtccgtccgggtaaaagatccgacgaaggatgaaatgaatgtatcattttaccggggcttccgttataccgcgcggaatccgggcagcgtgaaagtgtatcagcacgcctcattgacagaaccgccgagaggcatgaaagaaaatgaaatgccgtttaccctgccggaaatgaaccgcatctcggcaaatgacggaaaaaccgtctcgacggaaaacatggagcgtttcccttatcaccggtttgaagtgtccgttgacccgtctattgacgaaacggatcgggccgaggcggtctggaaaggaagctctctgcccggccggaaggtaaccatgtatatttggaattaccggacaagccgctggcaggaggcggacagcgtccttgccaaaaataaaaagccgtttacgttaaaagccgccgtgtccgcagccgatgcggtgaagaactcaaaaatgaatgtcatcgtgcaggatcaaataccggcgaaaggcaattactcatttgtctggatgtcggatacacagtattacgcacaaggtcacccgcacatttttgacaaaatgacggagtggatcaaagaaaataaggaaaagcacaatattaaatatgtctttcataccggtgatattgtcgatgattcgatggtgatgaaacagtggaaaaacgccgatcactccatgcggacactcgacaaggcggggattccgtacggagtgcttgccggaaatcatgacgtcggccataaagacggcacataccgaaccttcggggatttcttcgggagccgccgttttgaaaagaaaatgcattatggcgggtcatacaaaaataaccgcgggcattatgatctgctgtcggcaagcgggaacgattttattatgatttatatgggctggggcattacggatcaagagattgactggatcaatcaagtgctaaagcggtatccggaccgaaccgccatcttatgctttcatgagtacttgcttgtgagcggaaatcgaagtccgatcggggaaacgatctatcgaaaagtcgttaagccgaatcgcaatgtggcgatggtattaagcggccattaccataacgccatgaaaaaaaccgatgcgcttgacgatgacggggacggaaaaccggaccgcctcgtccaccaaattctgaccgactaccaggacggtccggaagggggacagggctttatgcgcatgatgcaattcgatcaggccgccaatcaggttcacatgttctcctactcgccgtacacggatgacatcaattactatgacaccgatctgttcgctgataaagacgaattctcagcagaaatggatttacagccgaagaggaaaagggttgcgaccgattattttgaatgcaacgtctatacgaacgaactgctcggtcataaaaaacacgtaaaaagcggaaaaaccgcaaattggatctgggacggcctgcagcctgattccgtttattactggtacaccgtcgttaaggacccgtacaacggcaaaacaatatcaccgctgtggatgttcaaaacgggaaatacgccgtatcgcccggctccggatcagtttgatttcaggcatgcctcaaacccataacgaaaaaaatacagcctgctgatcactcagaagaaaatctgacggtcagcaggattttttctgtacgtaaatggcggcgccctgctgtaataagtgcttttgacttttttatgtcccttttctatactaaaatcgattggttttcgtaatatgcaggaggaaacataatgaacagtaaaaccgggacaaaagaaagaattattcaaacctctgcatatctttttcagattcagggataccatgcgactggtttgaatcaaattataaaagagagcggagcacccagagggtcagtgtatcatcactttccaaacggaaaagaagaactcgccattgcggcgatcaaatatacgggaagatgcgttgaaaagcagatacagaatagtatgtctcaatccgcggaccctgtagaagcgattcagcactttattcatgtaacggctgaacagtttaatgatccgcagaatattgagggcgtgccggttggattgctggcgggtgagaccgctctgatcaatgaaacgttaagatgcacatgtgttgaggtgttcaagaagtggacggatgtgtttgcggcaaaatttcttgagcatgggtttgaacaagaggaagcggagaagcttgggatgacaatcaactcgatgattgaaggcgcaatcatgttttcattggctcataaaaacaaagaaccgctgctgctgatttcaaagcaggttccgtatattgtccaaaacagaggatagcattttattactcttttctttataaaaatagataccggaaccccagcctcttcgttttgacagagtcatagagaacattcaccggcttgatttgaaaatggcagatcaaaaaaacatctccaacccgtaacggttggagatgtttcatttcaccctgtccatataatgcacgaatgtgtagcggtcgcctctgtaggcggatttgacgtgctcaaaggcagtgccgtcctgcagataagtggtccgcttgatatagaggacgggcgcgccgggctggatgccgagcagctcagcttcttcctcggaagcggctcccggttcaagctcttgttttgcccgtgagatcggcatctgattgtacgcttcaatatgctcatacatggatgattgaaaatgggaggtatccaattttcccgccttgtcaaacgggatgtacgatgcctcaatcgccatcgggatatcatttgccagccggacgcggatgattttatgaagcgttgccggatagccgcatcccaggatagaagataattcttccgtcgcctgaatcagctggtattcggcaagtctgctccccggcttcatgccccggcttctcatatcttccgtaaagcttgtcagcccttgaagcggctgttccatcttcagtttgctgacgaacgttccccggcctttctgcctgtataaaaatccttcattcaccagattggaaagcgcctggcgcaccgtcattcggctgatgccgaattgttcggcgtattcccgctccgacggaagcagcgcatccgctttcagctcgccgtttttgatttgtgtttttaattgttccataatctgaaagtaaatcggaatcggagattgtttatcaatctgcataggtcaaatcctttcaatcgccgcccgcagcctgttcatcaatcaagaccgtcacatccggatgcgcgtgcagggcggaggcggggaatgcttcgctgatgcgcccgtccagaagctgcttcaccgcttgggccttgctttttccggatgccatgatcaaaatccgtttgccggacaaaatcgtcccgatccccattgtcagggcttttacagggacttgatcaattgacggaaagtaccgcgcattcgcctgtcttgtctcttcattcagctcaacaacatgggttcgggattcaaatggcgtcccgggttcattaaagccgatatggccgttgtgtccgatgcctaaaagctgtatatccgctccgccgagtgtttgaatcaatcggtcatagcgtccgcattcggcatcaagatcgtctgcccgtccgtcagggagaaagtggcggtcctttcggctgtcgatatgtgcaaaaaaatgtgtattcatataataatgatagctgtttttgtcctcgggagaaagcccggcgtattcgtcaaggttgatcgtcgtgacatttcggaatgacaagccctctgagcggtgcatccgcacaagttctttgtatacgccttcaggagtgccccccgtcgcaaggccgagaacggcatccggcttttgtttcactgtttcagcgataatcgatgcggctttttcacttaattcttcataatgtctgcatgtgataacgttcatgtccaatcagcctcccttgagatatatgcggtgtttccgcggcaaatcgtgaccagcacgccgcactgtccgtccgtcagaacaacgtcggcgtcttttccttcggcgatgcttcctttacggtcgaatatgccgaggcggcgggccgcatttgccgatgtcatatttgctatatccggccatgagcagtttgtaaacctgcgtatgagcgctgcgccttcattcatttttaaaatggaaccggccagcgtcccgtcagagagaagcgccgtgtccccgcgaacggtgactttttgtccgccgaactcgtattctccgtccttaagcccttttgcccgcatggagtctgtaatcatgatcagattttggcttcctttcgccaaataggcaagcttaacggccagaggatgggaatgaatgccgtcggtgatcagctccgccgtgatgcggccgcaggcgagagccgtaccgatgccccccggctcacggtgatgaaaggagctcatggcgttgaagaggtgcgtcatatgcaccgccccggcatccgccgctttttgtaaaagctcggctcccgcgtctgtgtgtcccattgacgggatgatgttttggttttttaaataacggatcaggctgaaatcaggatcttcttccggcgcaagcgtcacgattttgatcagccctcccgagagccgctcccatttctgaaagagtccggcatcagcaggagtaatccattgtttcggctgtgctcccgcctttttcggagagacaaacggtccttctaaatgaatgccgatcaactcagcgcctttttgggcctgcggtgaggaagacgcccattttttggcgttgacgagcgctttttcaatgttttcgtgctgctgtgtgatcgttgtcgctagaaaagaggttgttccttcttcgggcagccgggcggacattgtatcaagagctgcaacatcagcatccatcgtatccgcgccgtatccgccgtgaatatggatatcaatcattccgggaagcgcatatgaaccctcgggcgccttccattccttctcatacgtttcttgcggtcttgttttccccgcgtaagaaatgatgccgttctttataccgagaaatccgtttcggatgatttcttcttctgttacgatgtccgcaccgctgattaacaagctttcagccactttaaaacacgcctttctggttagttgttagttttattttactctttttcagactagttatctagaccagttatgccggaattgtataaatctgttttggttcagacggtaaagtgataaaatataactgttcaaagctcggaacatcccagaacaggaggaacatatcttggcaaaggttcggaccaaagacgtaatggagcagttccatttagaattgatcagcggagaagaagggattaaccgcccgattacgatgagtgatttatcacggcccggtattgaaatcgccggttattttacatattacccgagagaacgggtgcagcttttaggaaaaacggagctgtcattttttgatcagcttcccgaggaagataagaaacagcggatgaaatcgctgtgcaccgatgtgacgccggctatcatactttccagagatatgccgatcccgccggagcttgtagaagcttccgagcaaaacggcgtgcctgtgctcagatcccctctgaaaacaaccaggctgtcaagcaggctgacgaattttcttgagagccgtctcgcgccgacaacggccattcacggcgtgcttgtggatatatacggcgtcggcgtgctcattacgggaaaaagcggagtcggtaaaagtgaaacggcgctggagcttgtcaaacgaggccatcgtcttgtcgcggatgactgcgttgaaatccggcaggaggatcaggatacccttgtcgggaacgcgcctgatctgattgagcatctgctcgaaatcagggggctcggcattataaatgtcatgacgctgttcggagcgggcgccgtcagaagcaataaaagaattacaatcgtcatggaccttgagctttgggagcaagggaaacaatacgaccgtctcggacttgaagaagaaaaaatgaaaatcattgatacggaaattacaaaactgaccattcccgttcgcccggggcggaatctcgccgttattatcgaagttgcggcgatgaacttcagattgaagcggatgggcttgaatgctgccgagcaattcacgaataagctggcggatgtcattgaggacggcgaacaagacgaataggagttggcaataatatgaatgaagcaggaacaccaatcaatccgattgcctttcagctcgggcctttatccgtgcactggtacggaatcattatcggcgcgggcgcgttattagggctttggatggccatgagggagagtgaaaagcgggggctgaataaggacatttttattgatcttgttcttttcgccatcccgatcgcaatcatttgcgcaagggcatattatgtgcttttcgagtggagctattactcggaacaccccggggtaatcattaaaacttggaaaggcggcattgcgattcacggcggattaatcggcgcgatcgcaacgggaattgtcttttcaaaagtaagaggcatctcattctggaagctggcggatattgccgcgccgagtattctgctcggccaggccatcgggcgctgggggaactttatcaaccaggaggctcacggtgaagcggtcagccggtcatttttggaaagtctgcatcttccggatttcatcattaatcagatgtacatagacggacaatattaccacccgacgtttttgtatgaatcgctgtggagttttgcgggcgtcgtgattctgcttctgctccgccgcgtgaacctgcgcaggggcgatctgtttttgacgtatgtgatctggtattcgatcggcagatactttattgagggaatgcggacggacagcctgatgcttacgagccagcttcggatcgcgcaggtcatttccattgtgctgattgtacttgcgattattttaatgattttcagacgcatgaaggggtatgccgataagcggtatgccgacacggactgacgcctgaaatcggaaaggacataagatgactgataaacgtgtaaccgccattttattcgatctcgacggcacgctgattgacacgaatgaactgattatcgcttcttaccttcatacgcttgatcattattgcccggggcagttcaaaagggaagatgtgcttccgtttatcggcccgcctctgtatgaaacgttttcaggcattaatgctgaaaagtgcgatgagatgatcagcatgtacagagcattcaaccatgaaaagcacgatgagctcgtcacggagtacgaaacggtttatgaaacgcttgatgaattgaaaaaagcgggctatcagctcgggattgtcaccacaaagctgagggatacagtgaatatgggattgaagctgacaggcatcggggcgtttttcgatactgtcgtcacgcttgatgatgttaagcatccgaagcctgaccccgagcctgtgcggcttgctctcagccggctggggtgcgatccgtcggaagccataatggtcggtgacaattatcacgatgtcatggcgggcaaaaacgccggcacgaaaacagccggcgtcgcgtggacgattaaaggcgcacaggcgctttccgcctatgaacccgattatatgctcgagaaaatgagtgatttattgcacatcaccggagtgaagtaatccgtgagaaaaacagaccgccatccggttgcaggtgcaaattcattgtggcatgtttatcagacggttccctttctgaaggtgatgaaaaatttcatcatcattcagatcgcaaggtatacgccgtttttaagcgtgaaaaactggctgtaccgaacctttttgaaaatgaatgtcggaaaacagacgtcattcgcgctgatggtgatgccggatatcatgtttcccgaaaaaatcactgtcggaaaaaacagcatcatcggctacaatacgacgattttggctcatgaatacttaatacatgagtaccggaccggttttgtcacaatcggtgacaaggtgatgatcggtgcaaacacaaccattctgcccggcgtcaccatcgggagcggagccgttgtatcagccggcaccctggtgcacaaagatgtcccggccggggcgtttgtcggaggaaatccgatgcaggtgatctatacggacgaagaaatgaaaaaacgaatggaaaaccccgctgattaacgtcagcggggtttttttatgacttgatcacaatggcctggctgcccatctgcttccaggctttttcaaagtcagaccggtctgtttttctgtttttatagccgtaaggatcattaacgtatacataatcgtgatcataaccggtgacggctacgctatgcatgctgaacgtaatgtcgatctttccgttcggcgtattccaagtctgcatatgatcaaccggcttaaaggatgtggtggtaatcacccagaccggccgccctttttcaagctggcggtacactgaagaaatgtcttttcccgtcaggtcgtatactttgtttcccgcatactctttggcaagtttatcaatcggctcatgataaacgcctaaacccgggccgttttccatatctccggcaaatccttcattcggatctcccttcagcccgctgctgtatgtgagcggaactttattgattttatccgccaatgtattttttgacacatgatatccggcattgttcaaaatcatggcaaggctcgtcacctcacagccattgtacagtctgggagaatccatctgtctgtacagaacgacattcagcggtgacgcgctcccttttaacggtgttttctcatcaggctcgtcggactgctgattaaaaaaattcaaatgaatatcgtttgtatagatgttatacccgagatagacaaggatggctgtcagaatcagcacacataatgttccaagcgtcttcattattactctcccttgtttctgatgaagctattctatgtattatagcacttctgctcaatatgattcgatcgttccggtatgtttacaggtttgttcattctttagccatgtttatggaaaagaataggcggacattgagcgttgcaattcattcttttatctgctaacatattatcatattagcgaactaaaggattccgaattttccttcagataaagcggaggtgtaaaaggcaaatgtttatgtttgagaaaccgcatggcatgagagatacgctgcccggtttatacgaagccaagaaaaaagtccgttccacactgacggatttaattgataaatggggttatcagtttatggagacgccgacccttgaattttatgaaacagtaggcgtccagtcagctattgaagaacagcagctgtttaagcttctcgatcaggacggaaaaacgcttgtgcttcggcctgacatgaccgggccgattgccagggtggcggcgtctcagctgcacaaacacaatcatccgctcagagcggggtacgcggcaagcgtctatcgcgctcaggagcgggaaggcggacgtccggccgaattcgaacaggtcggcgcggagctgatcggcgacggatcaacaagcgcggacgccgaggtgattgcgctggcggcaggcgctttgaaaaacgcgggattgcaccggtttaaaatcgcgatcggccatgccggactcgctgatgagctgtttgtcgaggttctgggcaatgccgagcgggcggatgttctgcggcgctttctctttgaaaagaattacgtgggatacagggaacatgtcaaatcgcttccgctttcttcaatagacaaaagccggctgctcgcacttctggaattgcgaggcgggaaagagatctgcgccaaggcggaggagatcatcggcatctccggacaaagcttgattcaggagctggaagacctgtgggacgttcttgaggattacgggtgtgccgagcatattcgccttgatctgaatatggtcagccatatgagttattacacgggaattttattcgaagtgtacgcggcaaatgtcggtttcgtcatcggaagcggcggacgctataacaatcttctcggccatttcggcagtcccgctcccgccacgggtttcgggctccgtatcgacaggctgattgaagcgctcggcatccaggaagaaacaagtgaagcggacgccgtgattttcagcaaggagcagcgggcgcaggccattttattcgcggaggaagaaagggcgagaggcagaaaagtcgtcctgcaggatctggcgggcattgaaaatatcgatcatatgacaaaatcattcgcaaacgtcacatactttatcggtgccagaaaggaagagcggaatgggtaaggtactcacaatggcaatgccaaaaggacggatattcgaagaagcggccgggttgctgcggcaggccggatacaggctgcccgaggagtttgaagaatcgagaaagctgatcattgacgttcctgaagaaaatctccgctttattctggcaaagccgatggatgtgacgacctatgtcgagcatggcgtcgctgatgccggtattgccggaaaggatgtcatgcttgaggaagagcgtgacgtgtatgaggtgctcgatctgaaaatcagcaaatgccatctcgccgttgcgggacttcccggagtggattggaacggggtcgccccgaggattgcgacgaaatatccgaatgttgcgtcaagttatttcagagagcagggcgagcaggtggaaatcattaagctgaacggttcgattgaattggcgcctttaatcggccttgctgacagaatcgtcgatatcgtatcaaccgggcggacattaaaggaaaacggtctcgttgaatcagaacatatttgtgacatcacatcgcgttttatcgtcaatccggtcagctaccgcatgaaggatgatgtaatcgacgaaatggcggccaggctggccagggttgtggaaggagaaacggcacaatgaaaataaccgcagtaaaaagaagcgagcggttctcactgaagcgttccatcgacagcggaaccgaagagcagcggaaaaccgtcagggggattattgaagacgtcagacaaaacggtgacaaagccgttttggcctatacaaaaacatttgacggcatcagcctgaatcaaatggccgtgagcgcagaggaagtcaccgaggcgtaccgtctgcttgatgatcagctgctggaagtgatcagacaggcgattgccaatatgaaagaatatcacgaacgccagctgcaatcttcttggttttaccatcgcaaagacggcacgatgctcgggcagaaaataacggcgctcgattccgcgggcgtatacgtgccgggcgggacggccgcttatccgtcttccgttttaatgaatgtcatccccgctctcgctgcgggagtggaacggatcgttctcgtcagtcctccgggaaaagacggccgcctttcgccgggcgttctggcggcggcgtctgagctcggcataaaggaaatttacaaagttggaggcgcgcaggcgattgccgcgctcgcttacggaaccgaaacgatacagcctgttgataaaatcacgggccccggcaatatatttgtagcgctcgcgaagcgcgaagtcttcggcgttgtggatattgacatgattgccgggcccagtgaaatcgtggttctggcagacgatacggcggtgcccaaagaagtcgccgctgacctgctttcacaggccgaacacgatacgctcagctcaagcgtgcttgtcaccgattcacgaaagcttgccgaagccgtatcagatgaggtgaataaacagcttcagaccctgccgcgtaaagaaatcgccgaagcgtcgatcaaggatcacggccgcatttatattacggaatcgatggaagatgcagtggacacggtgaatgcgctggcgcccgagcatttagaaatcatgacgcattcgccggaggctttgcttggaagcatcagacacgcgggagcgattttcttaggacgatacagcgctgaaccggtcggcgattattttgccggaccgaatcacgttttgccgacaaacggaacggcgcggttttcaagcccgttgaatgtaacagattttcaaaagaaatcgagcatcatctcttacagccggaaggcatttgaaacgcacgcagacagcatttccgccttcgcgagactggaagggcttgaagcgcacgcaagatcgattgaagcgagaaacggaggaatgaccgatgagaaaagcggaacgcgccagaacaacaaatgagaccgatattaagctggctttcgaaatagacggagaaggaaaagccgatatcagcacggatgtgccgtttatgactcatatgcttgatttgttcacaaagcacgggcaattcgatttaactgttgacgcaaaaggcgatacggagatagatgatcaccatacgactgaagatatcggcatctgtttagggcaggcttttttggaggcgctcggtgataaaaaagggatcaaacggtacggatcagcgcttgtgccgatggacgaagcgctcgcccaagtcgccgtagacctgagcaaccggccgcaccttgagatgcgcgctgcatttccgcaagcgaaagtcggaacgtttgataccgagctggtacatgaattcctatggaaactggcgctggaagcgagaatgaatctgcacgtcatcgttcattacggcacgaatacccatcatatgatagaagccgtgtttaaggcgcttggcagagcgcttgatgaagcgtcatccattgatccgcgcgtcaagggtgtgccgtctacgaaaggaatgctgtaaatgatcggtgtaattgattacggtatgggcaatttattcagcgtgtcgaaggcgctggaacgcgtcggcgtcccgtatgtcgtatcagaccggccggaagagcttgaaaaagcggatgcttttattcttcccggtgtcggatcattcagtgacgccatggacaatttacgcagcacgaagcttgatcaattcatacaccgtatggttgacgaggggaagctgctcctcggcatctgcctcggcatgcagctcattttcgaagaaagcaccgaaaacggctctgcaaaaggacttggtttattagccggaaaagctgtgagactcaaagacagagatgccgaaggaaaaaagctgaaggtgccgcatatgggctggaaccggctgacgtttcaccaaacgtctcctttgctttcggaagcggaagaaggcttcgtttactttgtccattcctattatatagacgggatggaagacggcgatcttctggcaagcgctgagtacggcgttcgtgttccggccatcgtcgggaaacgcaatgtcttcggtgcccagtttcacccggaaaaaagcggtacggccggaatggcgatcttaacgcaatttacaaaaatggcagcggaacagaaggtgaagaaatgaacgcttttacattatatccggcaattgatatgagaaacggcaaatgcgtccgcctcatccaaggcgattacggcaaggaaacgatatacggtgactctcctttagacatggcggcgcaatttgcacaagaaggtgccgaatggattcatctcgtggatcttgacggcgcgaaagcaggcaggaaagtaaacgacaggcatgttcttgacattgcgcgtcagcttgatgtcaaagtcgagatcggcggcgggatccgttctgaagcggatgtgtacggttatttatcacaaggcgttgatcgcgtcattctcggcagcgcggccgtttccgatccggcatttgtgaagagcatgctgaaacaatacggcggcaaaatcgcgatcggccttgatgcaaggaacggatatgtctcgacggaaggctggctggaaacatcctcggtaagagcggccgatctgggccgtgaattggcggccgaaggagcggaaaccttcattttcacggatattgcaactgacggcatgctgtcaggaccgaacatcgaaagcaccgttcagctcgcaaaagcaacgggaaaaaccgtcatcgcttcaggcggagtcagctcagtcgccgacctcaaagcactggcccgcttcaaagacgccggcgtatcgggagcgattatcggaaaagcgctgtatacaaaacaatttacattggctgaagcgctcagcggggtgaaggacgcatgatcacgaaacgaatcattccgtgtctcgatgtgaaagaaggacgcgtcgtcaaaggcattcaatttctcgggctgaaagatgcgggcgatcctgtcgagctggccgaagcttacgacagggagggcgctgacgaacttgtttttctcgacatttccgcctctcacgaaggccgcaagacgatgacagacgtcgtagaacaggttgcggcaaaactggcgattccgtttacggtcggcggcggaattaatcaattaagcgatatgaaacgaatgcttcgcgccggcgctgataaagtatccgttaatacagcggccgtcctccgccccgagctgattacggaaggagcggattttttcggctcgcaatgcatcgtagcggcgattgacgcaaagtatgacgaagattcggattgctataaagtgtacacacacggcggaagacagaaaaccgactgggaagtcacggcctgggcaaaagaagccgtcagccggggagcgggcgaaatcctgctgacaagcatggatgctgacggagagaaaacaggctttaatcatacgctcacacagcttgtcacacgtgccgtcccggtgcccgtcattgcgtcagggggagccggcagcgcgcgccatatgcttgaagccttcacgatcggtgaagcggacgccgcgcttgcagcttccattttccattacaaagagacatctataaaagaagtgaaagattatatgaagaaacacggggtgaatgtgagatgaaacgggcagatgaactgcggtttgacgaggccggactgattcccgccatcgtacaggatgcggcaagcaaagaagtgctgacactggcttatatgaatcgtgaatcctatgaaaaaacgatagaaacgaaagaaacctggttttacagccgttcacggcaggagctgtggcataaaggagcgacgtcggggaatacccaaaaggtgaaagccatccgttatgactgcgatcaagatgccctcatcgtgcttgcggagccctcaggacccgcatgccataagggaagttacagctgcttttctccggaaaaagcggacgcgcagggtcgtttcggcatcttaaacgaactggaaagcgtaatcgccaaacggcaggcggagatgcctgacggagcctacacaacgtatctgtttcgggaaggcgtcgataaaatcctcaaaaaagtcggcgaagaagccgcagaggttattatcgccgcgaaaaaccgcgaccatgaagaattaaaatgggaagcggcggatttgctgtatcatttgctcgttcttctgcgtgagcagtcgcttcctttggacgacgtgcttgacgtccttgcgaaacgccattcagcatctgagtaaaacaaacctcacggagagatccgtgaggtttttaatctgtcaaacttaaacattcaattaaatattccttatttccgcaaccggaggcagatgaatttgataatattgactaatagagtttattttggtttttgtcaaaaatgtacgttttgttcatattccgttcatgcacatccgttatagtataaacagtgatataggaggaaaacatatgccgaataaacaaccaaaacctaaagggaaattcagctcattcttttcattagtcaaaaaaacaaaaccatcatacggtatgctggccttcgcgctgtctctcagtattgtgacaacgctcgtcagcctgctgattccgctattgacaaagcagctcgttgacggcttttccatgtcgtcgctgtcaggcgtgcagatcggaatcatcgcagccgtgtttatcgtacaggccgcattaagcgcctacgccacctacgccctgaactacagcggccagaaaatcatctcgggactgcgtgatttgttgtggcagaaattaattaaactgcccgtctcttactttgacaaaaacgccacgggagaaacgatcagccgtgtcaccaatgacacaatggtggtaaaagagctgatcacaaacaatatcagcggatttattaccggaatcatttccgttatcgggtcactgacgatcttatttttcatgaactggaagctcacattgctcgtgctgatcgtcgtgccgctggctgcggtgattttagtgccgatcggccggaaaatgtttaaaatttctcgggaaacacaggatgaaacggcgagattcaccggattattaaaccacatcctcccggaaatcaggcttgtaaaagcgtcaaacgctgaagaagcggaatacggacgcggaaaagcaggcattatggcgctctttaaactcgggctgcgtgaagcgaaggtgcagtcgctcgtaggcccgcttattacacttgtattaatggcggcgctggtcgctgtcatcgggtacggcgggatgcaggtgtcatccggtgaattgacagccggcgcactcgttgcctttatcctgtatttgtttcagatcattatgccgatgggccagatcacttcatttttcacacagcttcaaaaatccgtcggcgcaacggagcggatgattcatattcttgcagaaaaagaagaagatatccaaaccggaaaagccattgaaaacgcggatcagccgattaagcttgaacaagtctcattcggctacaaaacagatcaaaccatcttaaaagacattacggctacgattgaggccggcaaagtcaccgcgatcgtcggaccgagcggcggcggaaaaacaacgttatttaagctgcttgaacgattctacaatccgactgcgggcagcatcctgctcggaaatgaaccgattgatgcgtattcccttgagtcatggcgggagcatatcggctacgtgtcgcaagaaagcccgttaatgtcaggcaccatccgcgacaatatctgctacggattaaaacgcgaggtgactgatgaggaactgaggcaagcggctgacatggcctacgccctgcaatttattgaagacttaccgaagaaatttgaaaccgaggtcggtgagcggggaattatgctgtcaggcggacagcgccagcgcatcgctattgccagagcgctccttcgcaacccgagcattctgatgcttgatgaagcgacatcaagtctggacagccaatctgaaaaatgggtgcagcaggcgctggaagttctaatggaaggccgcaccaccatcgtgatcgcccaccgtttatccacggttgtggatgcagatcagcttctctttgtcgaacagggtgaaatcaccggacggggcacacaccatgaattaatggcatcccattcgctgtaccgcgattttgcggagcagcagctgaagctgaatgccgacttagaaaacaaagctgtgtaaagcaagactttatgaataaaaagcagctgaaaaagctgctttttattttgcagccggaatcctgttcatacgggtgtacggtcggtaacgatgaagagccaagccataagcgtgtatgccggtacaggagacaatgaaaaaattcggtttatagacatcatgtcgattcatgaaaagaaaaaagcagaaggagggattttcatggctgtcatattggttgcggatgacgaccgccatatccgtgagcttgtccgccttatgatggagcagagcggttttgacgtcgcagaagcggaagacggggaagcggcggtgcggctgatcgaatcagcacctatagatctcatcatactggatgtgatgatgccgaaaatggacgggtttgaagtcagtgaagccgtccgcagctttacggacattccgattttgatgctgacggcaaaaggcgaaacgctggacaaagtgcaaggttttacttccggagcggatgattatctcgtcaaaccgtttgagccgcttgagctggaagcaagggtcaaagcattgctgaaacggtaccggatcaccgctgaaaaactgctgaccatcggaacggtcacattagataagcaatcccgcaccgtaacgcgcggcggcggagcgggattgacactgccccggcgtgaatttgagcttttatttaagctcgccggttatccgaataagacgttttcaagagaacaattaatagaagatatttggggctttgattatgaaggtgacgagcggaccgttgatgtgcatattaaaaggctgagagaacggtttccggaaaaagactatccgtttgccatccatacggtgcgggggctcgggtatcggtttgtggtgacaggatgaaacggatcttcagaacggctgggaaaatcatcatccttctcaccgtcaccgcattcttatggctggcggctcacctgatcgttcagggattcggtctcatatggccgattttgcttgtgccgtacgccgagcagattctgacgctttggcttgttttcggcctgctgtttgtaacgatgtttattttttcaaagtcagcacgtgaaagacatcatgcgatctgggattcgctgaccgccacgatcaagcaaatgtcgagcggcaacttcacagcggccgcttcccggaaaatggagaagattgagaggaaccaccccgtgacgaaattggctgatgaactgtcgacactcgccgcggaactgagtgaaatggaaaaactgaaacaagaatttatttcgaacgtttcccatgaaatccaaaccccgctcacttcattaaagggctacgcgcatcttctgaaaaaaccggatttatcatatgaggagcgggggcgctacttacacatcatcgaaacagaaacagaacgattatcaaaaatcagtgaaaatctgctgaagctcactgcgcttgaacgccaaaccgaaccgatacaaaaaaaaccgttccgcattgacaaacagctgcggcgcaccatattgacctgtgagcctgaatggtccgccaaacagattgagtttctcattgatttacaggagtcgtatgtgtacggagatgaagcgctgctcagccaagtatggatgaatctgattcacaatgccgtaaaatttaccggtgaaggcggccgcatttccgttaaaattgcagatctgccgggagcggcggctgtcgaaatcgccgacgacggaatcggaatggagcctgaacaggcggagcgtgtatttgaacggttttataaagcggacaaggcgagaaacgcagggggaagcgggctcggtctgtccatcgcccaaaaaatcgcagagctgcacggcggttcgatagagattgagagcaagcgcggcgaaggaacccttttccgcgtcattcttccagccgagcctcgtgaaaaaaacagctaaaatctggtcgaaccagccagtaaaaaacgaagccgatcctgtcttttgaactattgaggcgaaaccgttttatggtatactactgacggtaatacgtataaaacggaggatatttgtgggaaaacacacttctgaacagaaaaagcacgcgcaaattgtccagctgcttcaggatggacaatatttttttcataaaggcttaaaagcatataaagagcggaatttaaaacgggccagcaaactgattcagcgggccgtccacctcgagccgaatgattccgaaatgctgtcccggctggccgtcatttattctgaaatgggccactaccagcagtcaaatgagctgttcgactttattttggtgaacctgaaagaagaaatgcccgagtgtcattactttaaagcgaataatttcgcgcatttggggctctttcaggaagcatacaaagaagcagcggcttattccgacgccgatccggacggggaattcagcgaagagattgaaaatctgatggagcttttggatttcggcgaagcgggtgaaaacgaatcgctctatgaccaggatgagctgctgatcaggcaggatcgggcaaaaacgcttcttgagagcggccagcttcatgaagcggttgtcatgcttgaagagattacggccgattaccccgagctttggtctgcatacaacaacctggcgctcgcttacttttactcaggcaatgtcacaaaagcgaaacaaacggtattcgaagtgcttgagaaaaatgaaggcaatctccatgccctgtgcaacctccttgtattctgctattacgagagggaagatgaaaaagtcggagaattgagcggaaaactcgccaacgtgtatccgattttattcgaacagcgctataagctgggagcgacgctagcgcttgtcggcagacatgatctcggttataaatggctccgttctctttacaaaagcgggttcgaaggcgacgacacgttttattactggcttgccgcctcagcctacgggacaggccgcacagaatttgcggaaaccatttggaaaaaggccgaagccgaatttcccgaatcagaccggcccgcgccttgggcggagcggcaggaaccgctgcctgcttcacttgaacagcggcttgccgcctattatatcagcagcgctgaaggagagcggaaccagcttgaaaaagttctgacggcaaaacgcgccgtttcaccgtttgaacaagatttcgtcagactgctgctttccggtgaaaaaggcgcttcaggcgtttccggtgatgcgctgttcacgtatcggacggtcaagcttctggagaaagcggaagccgacagtttaaaaactgacgtcatgagctgctgggtttttcacgtcattcagcacatccgcgccgccgctgccgtacagaatgagcgggcatgggccgcagccatcgcatatgtatggaaagaagcaaacggcgaaaaaacgacgaaaaaagaaacggccgccgtttacggtataacgccggcaacactttcgaaatacatcagacaaatagatgatatattagaataaaaccgattctttctatataaagagtcggttctttttttatcagaaaggggcaaaacagaactttaccgccgaaaaaagaggtattcatacgtatttttttgctttttgaatcgaaatcgggctgtaatcaccgtttattttgcaaaatatgagatttgcaatcacattgaaatataactgtaataaaaattgtcgaaacatgatggtataatgagtctcgtacataagagattagtttattttacatgtgctgtataatctataccaatttaaaagatttaaagattcatacataaaaatcatcagcctcacgggtatgtgagggagcgtaactttgatgttcataatagaattccaaatgagaacaggtttaaagtaaaagggaggaaagaaaaagtgaaaaagagtttattaacacttggtttggcttccgtcatcgggacaagcagttttttgatcccgtttacaaaaactgcatcggcggaaacattagacagcaaaaaagcaaaaatcgaaagcaagcaatctgaggtggcttcaagccttgaagcaaaagaaagagaattgtctaagcttcaggacaagcaggctaagattgaaaaagaactgaaagacattaacgctaaagcgttggatacaagcaataaaatcgaagataaaaaagctgaaaacgaaaaaacgaaaaagcagatcgctgatttgaaaaaagaaatcaaagaaacagaagcgcgtattgaaaaacgcaatgaaatcctgaaaaaacgcgttcgttctttacaggaaaacggcggttctcaaggatacatagatgttcttttaggggcgacaagcttcggagacttcatttcccgtgcgactgcggtatcttctatcgttgatgcggataaagagctgatcaaacagcaggagcaggataaagcgaaactcgaagacgcagaagctgaacttaacgtgaagctgaaaaaagttcaagatgatcttgcgaaactcgagtctatgcaaaaagacctgaataaacagcttgatcagaaagacaagctttttgacgaagcgaaaaacggacagaaaaaagcggcttccgctatctctgatctgaaaaaagaagcatcaaagcttgcaaacgaaaaagctgacactgaaaaagaacagaagcgcattaaagctgagcaggctgcagcggctgccctgatcaaaaaacaggaagaagcgcaaaaagcttctgaagaccaaaaccaaaaagatgacagccagccggcaccggcggttaaaactgtgaaaaaagcggctgtttcaacagcatcatctgattcatctgacagctcaagcaaaccgaagagcacttcaggcggatcatctcataacagcggcggttcagatgattctgacggcggatctgttatttcaaattcaggcggtattgaaggcgcgatcagcgtaggttcaagccttgtgggtcaatccccgtacaaattcggcggcggacgcactcaatctgatattaacaaccgtatttttgactgctcttcattcgtacgctgggcttatgctaacgcaggcgttaacctcggacctgcaagcggcacaaacacagatacattaatcggaagaggtaaagcagtaagcgcgtctgacatgaaacgcggagacttagtattcttcaatacgtataaaacaaacggccacgtcggcatctacttaggtaacggaacgttcctgaacgataatacatcacacggtgtatccattgattctatgagcaatccttactggaagaaagcattcaacggcaatgtaagacgtgtcgtgcaataatgaataagacaagggccttctatcccggaaggctctttctttatttgtatacccgctcaggagccgactaatcatggtttctcagaaaaatgagcaaaaaaatagcgaattgccctcagatttaataggatatgggtaaggaatacgattgatggggattcttatccatatagggtgcgccccatttcgaaaaggagtgaatcatggtgtcagaagaaaaaatttatgatgtgatcattatcggcgcgggtccggcggggatgaccgctgctgtttacacatcacgagcgaacttatccacattaatgatcgaaagaggaattccgggcggccagatggccaacacggaggatgttgaaaactatccgggttttgaaagcattctcggccctgaactttctaataaaatgtttgaacatgcgaaaaaattcggtgcggaatatgcgtacggcgatattaaagaaatcgttgacggcaaagaatataaaacggtcaaagccggttcaaaagaatataaagcgcgcgccatcgtcatttctgccggagcggaatacaaaaagatcggcgttcccggcgaaaaagaactgggcggccgcggcgtatcgtactgcgcggtttgtgacggcgcgttctttaaaaataaagagcttgtcgttgtcggcggcggagactccgccgttgaagaaggcgtctatctgacacgcttcgcttcaaaagtcaccatcgttcacagacgtgacaaattgcgggcgcaaagcattcttcaggcgcgtgcttttgacaatgagaaaattgacttcaaatggaacaaaaccgtaaaagaaatccatgaggaaaacggaaaagtcggcagacttactcttgtggataccgtgacgggagaagaggaagaattcaaagctgacggcgtctttatttatatcggtatgcttccgctttctaaaccgttcgaaaacttgggcatcacaaatgaagaaggctacattgaaacaaacgctcaaatggagacaaaagttccgggcattttcgccgcgggagacatccgtgaaaaaacactccgccagatcgtaacggcgacaggcgacggaagtattgcggctcaaagcgttcagcattatgtagaagagcttgaggaaacgctcaaaaccgttaaataatcactgtaatgttcagtttttgaatcgttactgtgttttaattacgctgtaacacgggtgaaatactgatgttttaagatgaatgtagtaattgaccccctttttaatgaatacactttggcacggattccagtatccgtgccctttttttgcgattttctgttttctgtcaaataaaagaaaaggatgtcggtgtctctgcattgtgagagacatgccgaaacggtataatgaagagacgatgatttgttgagaaggttaggtgacgtacttgtgcaaagagtgacaaattgtgtgctgcagacagatgatcaggttctccttctccaaaagccgagacggggctggtgggtcgcgcccggcgggaagatggaaagcggcgagtccgtcagagattccgtcatcagagagtacagagaagagacgggcatttatatactgaatccgcagttaaaaggcgtgtttacctttattattaaggaacaggaacaaatcgtgtcagagtggatgatgtttactttcgtcgccgactcgtacacggggcggaatgtcgctgaatcagaggaaggcgttctgaagtggcatgacgtaaaagatatccacagccttccgatggcccccggagacgggcatatccttgattttatgatcaagggccaagggcttttgcacggcacctttacgtatacgccggacttcgagctgctcagctatcgtttagatccgcagcttatcaaataaaagtaagaccgcaggggggagaaagatgagtatgaatgaaaaccatgatattcagctcgtcatcattacgggaatgtctggagcggggaaaaccgtcgccattcaaagctttgaggatctcggctatttttgcgtcgacaatctgccgccttccttgctgccgaaatttttggagctgatgaaagaatcaagttcaaaaatgagcaaggtcgcgcttgtcatggatctgcggggacgtgagttttttgacaggctgattgaggcgctggatgaaatggcggaaaatccgtggattacaccgcgcattctctttttagacgctaaggattccatccttgtgacgagatacaaagaaacgaggcgttctcacccgctggccgctaccgggcttcctctcgaaggaatcgcgctggaacgccagctgcttgaagaattgaaagggcgctctcagctgatttatgacacatcggatatgaaaccgcgtgatctgcgtgaaaaaatcgtggcgcatttcgccacgaaccaaggtgaaacatttacagtgaacgtaatgtcattcgggttcaaatacgggcttccgatagatgccgacctcgtgtttgatgtaaggtttctgccgaatccgttctacattgaaagcatgaggccgcttacggggaaagatgaggaagtgtcatcctatgtgatgaagtggaacgaaacacaaaagtttattgaaaagcttgttgatctgctcggctttatgcttccgtcttataagcgggaaggtaaaagccagcttgtcatcgcgatcggctgtacgggcggccagcaccgctccgtcacgctcgctgagtatttggctgactattttaaaaaagatttctatactcatgtcactcaccgggacattgaaaagagaagccggaaatgaataagaagccgaaaatcgcaatcttcggcggcggaacgggtctgtccgtgctgcttcgggggttaaagcataagcccgttgatattacggcgattgtgacagttgctgatgacggcggaagttcaggccgtctgcgggatgaacttcaaattccgccgccgggtgacattcgtaacgtactggccgctttgtcagatgttgagccgctcgttgaaaatctgtttcagcaccgtttcaacaaaggaagcgacttaaccggacattcgctcggcaatttgattttggcagcgatgacaaatataaccggtgatttctttcacgctgtcaccgaaatgagcaaggtgctgaatgtgcgcggcagagtgctgccggctgccaacaccagtgtcgttcttcacgctgaaatggaggacgggcaggtcgtctccggagaatcgacaatcccttcttacggccagcggattaaacgggtgtttcttacgcctgaaaaaattgatccgctcccggaaacgattgacgtcatccgtcaggccgatttaatcattatcggtccgggaagcctgtacacaagcattcttccgaatctgctcgtgccgaaaatcggagaagaagtcgtcaaggctgcggccaaaaaagtatatatatgcaacgtcatgacacagcccggcgagacgctgcaatacagcgcggccgaccatgtcaaggcgctgaacgatcatatggagcagccgtttatcgacacgatcttaatcaacaatgaggagatccctgacgaaatcaaaagcaaatatgcgaaagagctggcccggcccgtcgacttcaatattgaaaagctgaaatccatggggcttgaggtcatcagggatcagattatcacgtataaaaatggcgtaatccgtcacgatacacataaagtggcttctcttcttgtcgatttattaagggactagaggccttttgaaatgaggtggctaatatgtcatttgcatcggaaacaaaaaaagaactgacgaatctggaagtgaaggactgctgcgccaaggcggagctgtccgcgctgattcggatgaacggttccctgtcattttcaaaccgccatctcgtgcttgacgttcaaaccgaaaatgcggcgattgcccgccgcatttatacattgctgaagaaacaatatgatgtatcggtcgaactgttagtcagaaaaaaaatgcggctgaaaaaaaataatgtttatattgtgcgcttttctgaaaatgcaaagctgattttagaggaattgaaaatcctcggagagaactttgtatttgaacggaatatttctgaggaactggtggcgaaacgctgctgcaaacgttcttatatgagaggggcgtttttggcggggggatctgtgaataatcccgaaacctcgtcgtaccacttggaaatcttctcgctttataaggaacataacgattcattatgcgcgctgctgaatgaatttcatctgaacagcaaaacgcttgaacggaaaaaaggctatattacgtatttaaaagaggcggaaaaaatcactgaatttctgaatgtcatcggcgctcacaattcactgctgcgctttgaagatgtgcggattgtcagagatatgagaaactcagtgaaccgcctcgtcaattgtgaaacagcaaacttaaacaaaaccatcggggcttctctcagacaggtggaaaatattaaatacattgatgaacggatcggtcttgaagcgctgccggaaaagcttcgcgaaattgcgcagctgcggattgattatcaggaggtcacgctgaaagaactgggggaaatggttgcaagcgggaaaatcagcaaatccggcatcaatcacaggctgagaaagctcgatgaaatcgcagaacagctgcgtacaggacaaagcatcactttgaaataaccgtacagaaaaggggagatcttatggttcaggggaaagtggaagtgcgtttaaagacgggattgcaggcgcgccccgctgcattgtttgtacaggaggcaaatcgttttgcatcagatgtgtttcttgagaaaaacggcaagaaagtgaatgccaaaagcattatgggattaatgagtctggcggtcagtacggggacggaagtcactctgatcgctgaaggcgacgatgaaaaggaagcgctggaaaagttgtccgcttatgtgcaggaagaagtgtaaacactttgtaagggggacggaacgatgaatgagtttctgaaagattgttatcaaacgataggctgggaaaaggattccctcgatttcagcaacctgccggagtttttaaaggcgctcgcgtatcggtttccgtttgaaaatcgcgcggttttgtccaaaaaagaatatgacgtcacgaaagaaggactgtggcggcacatggtgaaggaacctcatggcggcctttgctatgacttgaacggactgctttatttcatcctgaaagatgccggattggatgtcaaattgatccgcggaacggtctggaaaaacggctgggcgctgcccggcacacatgcggccgtacttctttccgccggagggaatgagtacatcgctgatgcaggcttcggcctcaatctcgccatgcagcctgtgccgatgtcgggagacgagacggtatcagcggccggagcgttccgcgtgaggatagaagagacggaattcggggcatacgtgcttgaaatgaacaaaggggacggctggcagacaggttacgcattttcgcttgaagaaatcgatgaaaaggacctcaagtctatgaaacaaacaatctttgaacatgaacgctctcctttcaacaaacgcctgcttgcttcaaagcggacaccggaagggcacatggttctgtctgaacgcaatataacaataaaaaaacacgatggcacggcggaaaacagcagaatagaccggtcagagtttgaagaaaaatttactgctcattttatatgaagctcgcaggttctctgcaaaaaaaacggcctccgcagggaagccgttttttgtatgtgtttatctcatttttgtaaaggttttataatgatctgtcgtcttataaatcagccagtcgcttgagtaaagaatccggtctgaatttctgaagcctgatgtatagttaatatccgcttcacgccacgtccgtccgcttttggcagggagtttgccttccctgtttgagaagatgtccccgccgatgcttttccccggggcgacgtccgccagattcccctttgatgccacccagccgagggcctgtgcttctgattttgtaatgtaattatcaggaagcttatgataggtctgaagataatccgcaaccccgtcaaacgtgttgataacctgtgcttcagtgtgcgccttgtgagaagatgtatccgtcttggcagccgttgaaaacagcatccccgccgcggagaacagcaccagcaaacaaacggaaatccacgataatcgttttttcaaagcaatacctcccatttttatcatgtgaagctgattccttttcattgtatcagcatcaagagaaaggaatagaaagaattttaaaatagtacttttgatctagtgaaaaataaaccccggctgaaacggccgggatttttcatctcattgaaattccttcgtgaggtttttcggtgtttttccgtatacggcgtcaatcatgttttgtgcggcttgcttgaacatattcaagcggatttttgccgttgctgacccgatatgaggaagcaatgtgacgttttccagctgcaggagcggattgtcttcggcgatcggctctttttcaaacacatctaaaccggcgccttttatccagccctcctgcaatgcgcggatgagcgctttctcatcaaccgtctttccccgggaaatattgacgaaacatgccgtatctttcatcaatttaaattcccgctctcccatcatatgataggtttcgtcagtaagcggcgtaattaacagcacaaagtctgatgttttcagcagtgtatctaagtcggcatatgtaaccccgagttccttctcagcgtccggttttctgctgcggttataatacagcacgtccatatcgaagccgaattttgcccgtttggcagcttgttcaccgattctgcccatgccgataattcctaatgtctgatggtggacatccataccgaaaagagattcttcctcaacggttccccatttgccggcgcggacgaatcgatccaattcggcaacccgtctggcggaagacaggattaatgaaaaagccagatcagcgacagtgtcatctaaggtgtacggcgtatgcgtgccgacaaccccgcgtcttttcatttcttcaatgttaaaattatcatagccgactgaattgttgctgacgaccttcagcttcggcgcgtgatccagtaaatcactgtcaatcgccgttccggatgtcagcagcccttcagcatctttcattttttcgtacagttcctcttttggaatggtatcttctttccagatgtcatagcggcaatgctcgcctatcatttgttcgacttccggcggtatcggtttcgcgatgaatacatagggtttcaacgggcttctcctcctttgtctttcttctctattttattatataagagaagcggtaacgtgagaaatattcaaacgtattacgataaatttctggttcttttgaacttaaaatgaaagaaaaagaaacgtacatgctggatttctccaaacaataacagaatccgcctatatttctgaaggcaaaatgagcggaaccgctgttttcaaaagctttataggttggtgtaaagataaattttattatttttgaaagatataaatgaacataatctgaatttacagtcaaattatcgtgtctttttttgaaagcgcttttgaggcctttttctgtgctataattccttactgtaagctgggtaagaaggcttgcaatacaatcggatgggagatgaatagaaaaatggtttctttatcaagcattttggagcacaaccagcagtttgtccaagaaaggaaatatgaaccttaccaaacgacaaaattcccgaaaaaaaagcttgtcatcgtatcctgtatggatacaaggctgacggagcttctgccgcaggcgatgggactcagaaacggcgatgccaaaatcataaaaaacgcgggagccattgtttctcacccatttggaagtgtcatgcggagcattttggttgccgtttatgaactgcaggcagaggaagtctgcatcataggtcaccgcgagtgcggaatgtcgggattaaatgcggcttccatattaaataaagcgaaagagcgcggcgtggaggacaaatgtctcagccttctgcaacatgcgggagtcgatttggaaacatggctgaccggttttcacagcgtcgaagaaagcgtggcccacagcgtgaatatggtcaggcatcatccgctcttgcctgaagaggtgccggtgcacgggctggtgatcgatccggggacggggacgctggatgtagtcgttgacggttatgaaacagtcaaaggaggatgcagctgacgatgcaatttaccggcagatatcagggatacaatttgcagaaatttcagaaagacctaatcgcgggaattgtggtcggaattgtagcgattccactgggaatggcctttgctatcgcctcgggggtcggtccggaatacgggctttacaccgttattgtggccggaattctgatttcgctgttgggcggctctaaatatcagatcggcgggcctacgggggcgtttgttcccattttatttgccattgtgatgcagtatggttttgagaatttacttgtagccggttttatggcaggcgttatgctcgtcctgtttggcgtatttaagctcggaaagattatgaaattcgtgccgaagccggtgatcgtcggatttacggccggaatcgcggtgctgattttctcggagcagattgcccattttctcggtctgcgcgatattcaaaagcatgaaagctttatcctcaacattgcggaaataggcaagaagatcggaacctttaatttgtacagcatcctcatcgcgggaattgctttggccattttggtgttatcagccaggctgatgccgaagattccgggcgcgcttgtggcgctgcttgtctctacagccgcggcggtcgtgttttttcctgacaaaatggcgacaatcggttctgcttacggggagattccgcggcagctcccggcttttcagcttccggatttctcaatcgataacatggtgatgatgttcccgtctgctttgatcattgcgcttctcggcggacttgaatccatattatcggcgatggtcgcggacaatatgaaaggatcacggcatgacagcaatagggagcttgtcgggcagggcatcgccaatatggcagcgccgcttttcggcggcataccggcaacgggagcgattgcgcggaccgcaacaaatattaaaaacggcgcagtttctccgatttccggtgttgtccacggagtcaccgtcctcctcgtcctgctcgtcttcgccccgcttgccgttcacgtaccgctggcaagcatggcgccggtattgatggttgtggcttggaacatgagtgagcggagggaagtcgccaatatgatgcggctgaaaaacactgattcattcgtactggcggcaacctttttgctgacggttctgtttgatttaatcatcggcgtttctgccggtctcgtgctcgcttttgttttctttatcagaaagatgagcgaatcaacaagcattaaaacaccgcatgccgctgtcaaatcggttaaaaatgattcatccgtcagcacatattccattgaagggccgctgtttttcggttcaattgattcactggaatcatcgctgctggagaggcttcaggaaaagccgaagacgcttattctgctgatgaataatgtgcattacatggatacctccgcagaagcggtgctggggaatgtgatgaaccggatcaaacggcataacgggagattgatgatcgtcggattgcaatcacagccgagagagctgatccggaagacggggctgtttcataaaatcgggaaacagcatttctttgagcatcaggacgagataacgggataaattcagatacggcctgtccatgaaaaagcggacaggccgtgtttttattcggtttcaaagcgcttgatcagtttttcctgatgggctttcatcgcatcttctaacgtgattccgtacttatcggcaaggatggccagatttccgaggacgtcacccatttcttcaatcagctcctgtctgcgttcagcctgggttgcgtccttttcatccggccggtctctgccgatttcatatgctcttaccgcccgggcgagctcacccgcctcttccattaaaaagccgattctgataaatggcccgtacgccgtccatcctcgtttttcgtaaaaatctttcgtccattgttctgcttcagccatctgcatgtgaaacactccttatgtcctgtatgattcttattgatattatcatatagagatgggacaatatatagtgtattttgatttattgatgtacatatatagatgcggagatgaaaaaatgaaaaccatttgtgtatttgcggggtcaaacccgggggtaaatgaagagtacaaacgcaaagcggccgaactgggtgaatatatggcggagcagggaatcggccttgtttacggcggttcacgggtcggtctgatgggaaccgttgctgatgcgttaatggcaggcggcggaaaagctgtcggcgtcatgccgagcgggcttttcagcggagagattgttcatcagaatctgacggagctgattgaagtcagcggcatgcatgagcggaaagcgaaaatgagtgaacttgccgacgggtacattgccatgcccggcggtttcggaacatatgaagagttatttgaagtgctgtgctgggcgcaaatcggcattcatcaaaaaccgatcggactgtacaatgtgaacgggtattttgagccgatgatgaagatggtcaagtacagcatccaggaaggattttcgaatgagtctcatttaaagctgatacacagttcctcccggccggatgagctgattgagcagatgaacaattactcgtacccgatccttcagaaaaaatggacggaaatataaaaaaagagccatctgacatgtgtgtgagtcccgggcggacttcatgaaaatcgagtgtatttgacaatgtgagatttccttagggaaatctttttttatgtccagattaccatcgtagtataatttaactaattcggattggctatctaagcaaaagcggaaggagacggaaaatggcgacgttgtcagatgtggctaagagagcgaatgtttcgaaaatgacggtatcacgtgtgattaatcaccctgatacggtaacagatgaactgaaaaagctcgttcattccgcaatgaaagagctgaattacatccctaattatgcggcaagagcgcttgtgcaaaacagaacacaggttgtcaaattgctgattctcgaggaaatggatacgaccgaaccctattacatgaacttgctgaccggaatcagccgggagctggatcgccatcattatgctttgcagcttgtgacaagaaattcactcaatatcgggcaatgcgacggcattattgccaccggcttgagaaaggccgattttgaatttgtcatcaaagcttttgaaaagccgttagtcgtatttggagaaaatgaaatgggctatgatttcgtcgatgtgaataacgaaaaagggacttttatggcaacccgccatgtcatggggctgggggagcgtgaggttgtctttttcggcattgatttggatgagccattcgaacgctcaagagaacaggggtatattcgggcgatgaaagagagctgcagagaaacgaagctgtttcggatcgctaacagttcaaaaaaaagcgaaagtctggcaagagaagttttgaaaacgctcggccggcaagccgcgtttgtctgcgccaccgaccgaatcgcgctgggggtcattcgtgcggtgcagtcactcggaaaacgaattcccgaagatgtggccgttactggaaatgacggtgtttttcttgaccgcatttcctccccgcggctgactacggtcagacagccggttgtggaaatgggagaggcctgtgcgaaaatgctgctgaaaaaaatgaatgaaggcggcgcagctcaaggtcatttgttttttgaaccggagttaattgtgcgggaatcaactttgtgaaagcttgattctgttatcggtaacaagagaaaaacgattgcttctcccgatttcatcatgctaccttcaaagcataagccagcctataaaaaagggggaaacatgatggaatatgccgcaatacatcatcagccgttcagtgctgatgcttattcttatgacgggcggacggtgcatatcaaaatccggacgaaaaaaggtgatgctgatcagattcgattggtttggggcgatccttatgaatacagcggcggcaggtggtcggcagccgagcagccaatgagaaaaacagccgcaacccaaaaccatgattattggtttgctgaagtgtcaccgccattcaggcgtttgcaatatgcatttattgtctcagaccagcatgaaaacatctttttcggagcgtcaggggtctgtcctgtaaataaaaaaacgctggaaacgattcattattattttaagcttccgtttgttcatgaggcggatacatttcaagcgcctgaatgggcgaaatcaacggtttggtatcaaatttttccggaacgttttgcgaatggaagagaagacctgtcaccggaagctgcactgccttgggggagcaaggacccggacgttaatgatttttttggcggagatttgcaggggattatcgacaagctcgattatttagaagaattaggggtgaacggaatttatttaactccgatcttctcctctccatccaaccataaatatgacacgctggattactattccatcgatccgcattttggggatcgggagcttttccggacattggtcagccggcttcatgagcggggaatgaaaattatgcttgatgctgtttttaatcatataggcagcgcttctccgcaatggcaggatgttgtaaaacacggggcccggtcccgctacaaagactggttccatattcactcttttcctgtgaaagaagacaattatgacaggtttgcgtttacgcctgatatgccgaagctgaatacggctaatccggaagtacagaggtatttgtttgagattgctttgtactggattcgtgaatttgacattgacggctggcgtttagatgtggcaaatgaagtggatcacgctttttggaaggcattcaggcaggctgtaacggccgagaagcccgatctttatattttgggagagatatggcattcctccgaaccttggctcagaggagatgagtttcacgctgtgatgaattatcctttcacagagccgatgattgcttattttgctgaccgggagatttctgcttcatccatggcctatcgattaaacgcgcacttgatgaatgggatgcggcaggccaacgaggtgatgtttaatttactggacagccatgatacagaacgtcttctgacaaggtgcggaaatgatgagaaaacagcccgcgctctgctggcctttatgtttgcccagacaggagcgccctgcatctactacggaacggaaatcggtctggacggcgggagagatccattatgccggaagtgtatggtttgggaaaaggaaaagcaaaaccgggaaatgctcagctttatgaaacgcttaatcaccttacgcaaaaaagaaaacgctttattgacgtacggaagtcttgagtggcatctgcttgatgatcaaaacgattgtatcagtttttcgagggttttcaatggcaggcaattgattttctattttaatcaggggaacctggcctgggatgtccgtttgcaagattttaatatggagagaagcagaaaagtttacgatgcgtggacggatcagatccttcaacatgatgccgctattgctgttcagccgggagaatttttgattttgagcgctgacgcccctgtctgaattctgttatcggtaacaggctgaaaggctttgaaaccgctttctctaacagagtagaattgtaatagattcataataaaagggggaaaagatatggcggggttcgtcaaaaagggattggctttattgacggcatcagttttggcattctgtctcggcgcctgttcaaattcaaaggaatcggccggcgctgacggcaaaaaggtactgaccgtgtccgttgaagaaacctataaaaaatatattgaaagcattaaaggagagtttgaaaaagagaatcacgtcacaatcaacattgcagaaaagcaaatgttcgatcagctggaggcgcttcctttggacggcccggccggcaatgcgcctgacgttatgcttgccgcatatgaccggatcggcagtttggcgcagcaaggccatttgcttgatctaaaacctgctgatacaaaaagctttggagataaagagatgcagcaggtaacggttaacggaaaggtgtatggaatgccgctggtgattgagacgcttgttctgtattacaacaaagatcttataaaaaaagcgccggcaacatttaaagaccttgaaacattaacagaggatccccggttttcatttgcttctgaaaaaggaaagtcaacgggatttttggcaaagtggactgacttttatatgtcgtacggtttgctgtccggttacggcggatatgtattcgggaaaaacggcacagatcccggggatatcggcctgaacaataaaggggctgcagaagcggtgaaatatgcggagaaatggtttaaaacgtattggccaaaaggcatgcaggataactcaagcgcagacgattttattcagcaaatgtttttggataagaaagcggctgcaatcatcggcgggccttggtcggctgccaattttcaagaggccggcctgaactatggcgccgctcctattccgacattgccaaacggaaaagaatatgctccgtttgcgggcggcaaaggctgggttgcttcaaaatatacaaaggaacccgagctggctgaaaaatggcttgagtatgcaacaaatgatgccaatgcttacgccttttatgagaagacaaatgaagttccggccaacacagccgcaaggaagaaagcgggagagcaaaaaaatgagctggcgtcagctgttattaaacaatatgagtcagcggcacctgcgccgaatattcctgaaatggccgaggtatggaccggcgctgaaagtttaatgtttgatgcggcttcggggaaaaaaacagcaaaaaaatcggcggatgatgcggtaaacgtcataaaagaaaacatcagagaaaagtatgtgaaataaaatcggaggggaagtgtccgtaagaatagagggcgaaaaatgaataaagatgatacacttttacaccaaaaacggaaggcgtcatggtttttatcgatcattccgggaattggacagatcgcgaatcagcagatatcaaaggggatcttatttctggtcattacgagtttgtttgctgttgaattatgcgttttcggtattgaggcgctgaccggattggttaccttgggaagtgttcccggtgaagatcactcattatttatgctgattgaaggcacgctgcaattgatcttaacgttgatttttctcatgttctatatcttttcagtttatgatttccgtcataccgccactatgaaagcggcgggtttgaaggtgaatacagcggccaaggatatcatccgccatgcgggagataaagggtttccttatttatttacactgccggcatatctcatgatggtgtttgtgattatttttcctgttctggtgactctgtttgttgccttaacaaactatgatttttatcatataccgcctaacagtctgattgactgggtcggctttaaaaatttcttgaatatcttttttgtcggttcctaccgggaaacatttgtgaatgtactgggctggaccatgatatggacaatctgtgcaacaacgctgcaaatcattttggggatcgtgacggcactttttgtgaatcaagattttattaaaggcagacggatattccgaatgattttcttatttccatgggctgttccggcctttatcacaattatgagcttttccaatatttttaatgacagtattggggcgatgaacacgcaggtgatcccattaattaaccacctgccgtttgtggaactgccggcgatcgcgtggaagactgatgctttctggacgaagaccgctctgattatgattcagacctggcttggctttccttatatttatgtcatggtaacgggggtcttgcagtcgattccgggtgaattgtatgaagccgcaaagattgacggagcttcttttatgcagcgttttcgcaatattacattaccgatgattttatttgcgacggcaccggtgatgattacacagtacacatttaactttaataatttttcgatcatctatttgtttaatgaaggcggtccgggaagcgcgggagccggtgccgggtcgaccgatattttaatttcctggatctataaactgacaaccggcacttctccgcaatatgctgtggcagcggccgtgacattgttaatttctttcgtcgtcattggaatatccctgattgcttttaaaaagtcaaatgctttcggcaatgaggaggtgatgtagatgggttccagaacggccggaatgcttacgaaaatctgcacctatttgtttttgctgattttaagcattgtcattttatatccgctgctgattacggcctcttccgctttccgtgcgggaaatgtgacggcttttcagctcgatttctcaggtccctggacttttgatcattttaagcggctgtttgaagagacgctctatcttcattggtacagcaatacgctggttatcgcgctgtcagtcatggtattgcaggtcacgattgtaacgcttgccgggtatacgtacagccgctatcggtttgcggggcgaaaaaagagtcttgtcttctttttaatcattcaaatggtgcccacaatggcagcgctgactgctttttatgtattggccatgctgataggcgctcttgatcaatactggtttttgacagcgatctatatcggcggcggaattccgatgaacacgtggctgatgaaaggttattttgatacagttccgagagaaattgatgaggctgcgcggatggatggagcggggcatttcaggatatttgcctccattgtgctgccgcttgtgaagccgatgcttgccgttcaagcgctttgggcgtttatggcgccgttcggggactatttgctggcgaagtttttgcttcgctcgccggaaaggctgaccattgcagtagggttgcagtcgttcatttcaaatccgcagcagcaaaaagtcgccctgtttgcggcgggagctatacttgccgcactgccgatatgcatcttgttcttttttctccaaaagaactttgtatccgggctggcggcgggcggaacaaaggggtagttcaatgaagaatgtgcaaaatgaaagctttatgatccgcagtcttaaagcatcggtgtctccgtcaggtatttgccgttacgggaaaacattcagctggcttcagctttcctttctctttatgtttttgacgtcctgccttatggcgccgtttacgatgtcgtttttgaaaatggaccgcttcagcctcaaattggttatgcctgtggcgctttctgcagtgaatgatcgttttgccgaacaattaaacggtattcaaatcaggaacggaaaactgacaggcggacagcgttttgatcaaattgaagagggcaaccatctgatggcagtcgatatggagcatgaatggaaaccaaacggtgaaaatgggcgtttgcgtgtaaaaggatatgacaacgcggtcatattccagcctgaccggctgattattaccgaccaaaacggaatggggttttcagttcgctatgggaaagcggacgccagtcttacggacccgggcgtatatgagacggaggctgttatcggtcaattgtggctggcacagtataagccgatgatcatgatgctggggtgcgcagtgatttttttgatccagctattttttacagctgtgcttgcgggaggcatctggatggcaaaattatcaaaaatgatcgatatcgcgtcatgtaaggaagcagcttctgcagcgatatgcgcatcggctctgcctgcattcgcggcagctgctatcgggctgatccgctttgatttgattactgtattaatggttcatacatgcggcgtcacgttgatgattgcttttttattcagatatatggccaaaacccgccgtcataatgaaaatgttcattcgggaggaagacatgataaatcagcggttgtttgagattgatgaatggaaaatcaaaaccaatacatttcaaaaagagtatatacggctgcaggaaagcctgacttctcttgccaacggctatatgggcatcagggggaattttgaagaggggtattcaggcggcagccatcaaggcacatatattgcgggcgtgtggttccctgacaaaacgcgggtaggctggtggaaaaacgggtatccggactatttcggaaaagtgatcaatgcgatgaattttattggtatagatgtgtatgttgacggtgaaaaagtcgatctctatcaaaaccgactcgaatcatttgagttagagcttcatatgaaagaaggaattctgaggaggagcgctgttgtccgtattcaggataaaaccgtgcgaatcaaatcagaacgatttctcagcctggccgtaaaagagctatgtgcgattcattatgaagcggagtgtctgacaggggacgccgttattacgcttgttccttatcttgatggcaatgttgtaaacgaagattcaaactatcaagagcggttttggcaggaaaaagagacaggagcggattaccgccgcgggcatataacggcaaaaacgctcgacaatccgttcggaacgccgcgtttcactgtctcagccttaatggaaaatttgacagaaggctatgtcagtcaaagctttcaaacttccggcatgtatgctgaaaatcgcttcagctaccaaaacaaagcttcattgaagaagtttattgttgtcacgacttcacgcgatgttcaagaagcagagcttacttcgaaaggggaggagcttttggcggctattcttaagcaaggttatgaagaagcgagacagcagcatattgccaagtggaaggaaagatgggcaaaagcggatatagagataaagggagataaggaacttcagcaaggcatccgctacaatatctttcagttattctcgacatactacggggcagatgcccgtttgaacatcggaccgaaaggatttacaggcgaaaaatacggcggtgccgcctattgggataccgaggcgtatgccgttccgatgtatttggcgacagccgagccggaagtcacgaaaaacctgcttttgtaccgctatcatcatttggaggctgccaaacggaacgccgccaagctggggatgaagggggcgctttatccgatggtgacgtttaccggagatgaatgccacaatgagtgggagattacgtttgaagaaattcaccgcaacggcgcgatttgctatgcgatctgcaattatgtccaatatacaggtgatcgcgcctatatggaggaatatgggatagacgttcttgtggcagtcagcagattctgggccggccgcgttcacttttcgaaacgaaaaaataagtatatgatccacggcgtcacagggccgaatgaatacgaaaacaacgttaacaacaattggtatacgaatgtcattgcggcttggacgttggattatactctgcaaagtctcgaaaggatctcagcggagaaacgccgccttctggatgtgcaggaagaagaattgaaagtctggagagaaatcatccggcacatgtactatccgtatagtgaagaactgcaaattttcgttcagcatgacacatttttggacaaagacctgcaatcagttgacgaattagatccagctgaacggcctctttatcaaaattggtcatgggacaaaatcctccgctccagctttattaaacaagccgatgtgctgcaaggcatttatttatttcctgaccgtttctctatagacgaaaaacgccgcaactatgaattttatgaaccgatgacggttcatgaatcaagcctatcgccctccattcacgcggtgctcgctgccgaattgaggatggaaaagaaggcgcttgaattatataagcgtacagcaaggcttgatctcgacaattacaatcgcgatacggaggaaggccttcacattacttcaatgacgggaagctggctggcgatcgtccaagggtttgccggcatgcgtactttaaaaggaacgctctcattcaccccatttttgccgaatgaatgggacggttactcgttccatatcaattatcgaaaccgcttgatcaaggtgacggtcgaagaaaggcgcgccatttttgagcttgtcaaaggcgaaccggtgtccatcacagtttatggagaaccaatggtgctgaatgaacgatgtgaaaggagaatgcctgatgagtgaatggtggaaagaagctgtcgtgtatcaaatttacccgcgcagtttttatgattccaatggagatggatttggggatttacaaggcattatcaaaaagcttgattatatcaaaggacttggcgcggatgtgatctggctgtcgcccgtgtttgattctccgcaggatgacaacggctatgacatcagtgactacagaaacatgtacgaaaaattcggaacaaatgaagatatgtttcagttaattgatgaagtgcatcagcgcggaatgaaaatcatcatggatctggtcgtgaaccacacgtcggatgaacatgcctggtttgctgaaagccgcaagtcgaaggacaatccttaccgggattattatttttggaaagacccgaaatcggacggttctgagccgaataattggggatcgattttttcaggctcggcgtggacgttcgatgaagggacaggacagtattatttgcactacttttcgaaaaaacagcctgatttaaattgggaaaatgaagccgttcgccgggaagtgtatgatctgatgaagttctggatggataaaggcgttgacggctggcggatggatgtgatcggctccatttccaaacataccgattttccggactatgaaacagataacagccgcccccatatcgtcggccgttaccactctaacggcccccgcctgcatgaatttattcaagagatgaacagggaagtgctttctcattacgactgcatgacagtcggagaggcaaacggttctgatattgaagaggcgaaaaaatatacggatgcaggcaggcaagagctgaatatgatctttacatttgaacatatggatatcgatacagaacaaaactcgccaaatgggaaatggcagatcaagccgtttgatgtgattgctttaaaacaaacgatgacaaggtggcagaccgggttgatgaatagcggctggaataccttgtattttgagaaccacgatcagccgcgggtgatttcccgctggggcaatgacggtgagctgcgaaaacagtgtgcgaaagcattcgcaacggttctccacgggatgaaaggcacaccgtttatttaccagggagaagaaatcggcatggtcaacagtgatatgccgctggagatgtatgacgatcttgaaataaaaaatgcataccgtgaactagtcatcgaaaacaagacgatgacagaaaaagagtttgtcaaagccgtgatgataaaaggaagagatcacgcgaggacgccgatgcaatgggatgcaggaaaacatgccggattcacagctggagacccttggttagcggtcaattcccgctaccaagaaatcaatgtgaaagaatccttggaagatcaagattcaattttctattactatcagaagctcattcaattacgaaagcaatataaggtcatgatatatggagattatcagctgctgctggaagatgatccgcaaatctattgttatatccgtaaatatcaagggaaaaagcttctcgtcgttgtgaatttgtcggaagacaaggcccagttcgaagcgcctccggaactgatccatgagcgctggaaagtgcttatttcgaactatccgcaggagccggctgacttgaagcgcatcagcctcaaaccttatgaagctgtgatgggcatcagcatatgaaagcggttatttttgatttagacggagtgataacagatacggctgaatatcattttctcgcttggaagcacatcgcagaacaaattgatattccctttgacaggaatgtgaatgaaggcctgaaaggaatcagccgggaagagtcactggaaagcatactgatctttggcggagcggaaaaaaggtttacacatgcggagaaacaagaactgctgcatcaaaaaaaccaatattatcaaacgttgatcagcagattgacgccggaagatctcttgccgggaatcggcaggcttctttgtgaattaaaaaatgaacatataaaaatcgggttagcatcttcaagccgcaatgcccgcgcgatcttaaaacgtttggcggttatcgatgattttcaagccattgttgacccggcggctcttgcgaaggggaagcctgatcccgaaatctttttaacagctgcagcgctgctcggtgtttccacggctgattgcgcggcaatagaagatgctgaagcaggaatatctgcaatcaaatctgccgggatgttcgcggtcggtgtcgggcgtgaacagtcgatgcttggtgctgatctggttgtgaggcaaaccggtgaattgtcgtttgagctgttgaaggaagaatggaagcagtataggggaaaggttttaaaaagcatcagagagtgaaaaaaacctgcaagagacatcatctcttgcaggttttttgggcattacttctggtcttctgtattgcgtgtcagcactttatcgattaagccgtattctaaggcttcatcagctgatttgaagttgtcgcggtctgtatcgcgctcaatgacttcaagcggctggccggtacgttcagcaagcactttgtttaatttgtcgcgaagcaagagaatgcgttttgccgcgatttcaatttctgtcgcctgtccttgcgctccgccaagcggctggtgaatcataacttcactgttaggaagcgcgtaacgtttgcctttttctccggctgcaagtaaaaatgctcccatagaagcggccataccgatgcagatcgtggatactttcggtttaatgaactgcattgtatcatagattgccataccggcagtgattgatccgccagggctgttaatgtaaatggaaatatctttttcagggtcttccgcttcaaggaataaaagctgtgacacgatggagttcgcaacgttgtcatcaatcgcagatccaagcatgataatacggtccttcaaaagacgggagtaaatgtcataagctctttctccgcggttcgtttgttcaatgactgtaggtattaaattcataatgctcctccttcaccttttaggtaagtatgtatttacatgatacatttttggtcaataaaggtcaaacaaaacgctgaccaaaatgccaaccttttcttctaacaccatttttcccataaaacaaaaagttcaaacagcaaagtggaaatgaggatgatcagcaccggcgcttgagaaaatgatatggccggagcgctcaaaatagaccgcaatcgcgtcgctacgtacggctgaagggtctgactacgttgtccgcccttccaaaagccgtaccggcaaatacgtttccagcggcaaatcatcaaattcgccttcaatttcttttgctaaaatctcgatggctgttttggaaatcaattcaatcggctgctggatggttgccaagtccggcagaaccgattgaacggtttcagtgccgtcataaccgatcacttttaattgattcgggatgtctattccccgttttttggcctcggtcatcacggcagccgccatgatatcatcgctggcaaaaattccgtcggtgtcaggctgttcatcgaataatgttgaaataatgtcatggtaatgctgataaaagggtacttcatatgtaataggcttccgtccgtgttcatgcatgacgtcttcgtatgcttttcttctgaggtttgccggtgtttcgagttcaatcgggccgttgatatggacgatgtgccggcaccctttttcaatcagcagttctgccgccttttttccgccgtcatagttgtctgagccgacgacgggaatcgtgtccgataagtaatgatcaatggcgacaatcggcagattctgcttgtgatcattgagaattccccggttgtaagtcacggcgatcacgccgtccacttggtttcttatcagcatctccaaatatttttcttccttatcctttcgatgtaaactgttgcaaagcagcagtttgtagcccatggacgtacaaatgctttcaatatgaaaggcgagttcgccgaaaaacggattgctggagtttgggatgataagtcctattaaattggttcgttttcggaataaagagcgggccagatcgtttggaaagtaattgatttcttccatcgccttgtacactttttcttttgttttttcgctgatatagccgcggttatttaatacccgcgaaacggttgtagatgaaactcccgctattttcgcaacatcatgaatgttaggcttcattcccgtgccctcctgcttactgaaatggcttacaatttccgtcacgcacttattttagagaatcaggctgacatgtgcaaggacattccatgtttctgttttcatataaagagggcgtgtttggtttgattgaaataatcagaaaattgtatgtcaaccgattgacatatggaaccggttgacatacaattctttttgaaagcgctttattcgcagagtgaagggaagtgacgggtatggagagatggctggcggcaataaagtgaaagaatcgagcaacggtgtaaagtaagcgcttactcagagctcgcatgtatgtgatgaaaatgaagaaggaagtatgcggctctaaaacggctattaaaaggtcctattaaaggagcggtgcaaatgaaaagctcaaaaagtctgtattggaaactgagtgcttatttcttctttttcttttttacttggtcttccagctattctttatttgcgatttggttagggcaggaaatcaatttaaacggatcagcgacaggcattattttttctgtaaacgccgtatttgccctgtgcatgcagcctctttacggttttatctctgacaaattggggctgaagaaaaagatattgtttatgatcagctgtcttctcatattcacgggtccgttttatatcttcgtctatgggccgcttttacaatacaacgtctttcttggcgccgttgtcggaggcttatatttgggagccgcttttttggcggggataggcgcgattgaaacgtacattgaaaaggtcagccgtaaatatgatttcgagtatggaaaatcaagaatgtggggctcgctgggctgggcggcggctgcattttttgcagggcagcttttcaatatcaatcccaatatcaacttctggatcgcgtctgtttcagccgtcatattaacggtcatcatcatgtctgtgaaaattgaaatgaccgatcatgagaaaaacagagcggattcggtccggttaaaagatgtggggcggctctttttactaagagatttctggttttttatgatgtacattatcggggtgacttgcatttacggcgtatatgatcagcagttcccgatctactatgcgtctttgtttccttcagtgtcgacgggtaaccaagtattcggctatcttaattcattccaagtgtttttggaggccggcatgatgtttcttgcgccttttatcgtcaataagttcggggcgaaaaacagtttgattttagcggggtttttaatggctttccgcatcgtcgggtccggaattgcagttgagcctgtaggcatttcatcaatgaaactcatccacgcactggaattgccgattatgctgatcgccgtttttaaatatttggctgccaattttgatacgcgtctgtcgtccgtcctttacctcgtcggttttcaattcgcatctcaggcaggcgcgtcgattctgtcgccgcttgcgggaggattatatgacagtgcggggttccgtcaaacctatctcatcatgggaatcgtcgtcttcggttttaccgtcatctccatatttactttattgggcccgaaacaaaacagcaggcgtgtccagcgtctgcaaaaaatcggatagagaggatgttacaaatggatagaattcagcaggcggaagaagctttgaaggaagccgagggtaaagtgaaacaaagatatcgattggggtaccatattatgccccgggcgaattggatcaatgatccgaacgggcttattcagtttaaaggagaataccacgtcttttttcagcatcatccgtatgatgagcattgggggccgatgcattggggacatgtaaaaagtaaagatctcattcattgggagcacctgccggttgccttagctccgggggatgaattcgaccaaagcggctgtttttcgggaagcgcggtcgatgatcatggaagattggccctcatctatacaggacataatataattgatcaagagaaagacctattctatcaaactcaaaatatcgctgtcagccaagatggaaccgtgtttgaaaagcttcaggaaaaccctgttattgcggaaccgccggaagacagcgcccgtcatttccgcgatccgaaagtatggaagcatcgcgatgtttggtatatggtcatcggcaactcctcaaaagaaaacgtcggacgggtcgttttataccgttcacctgatttgcgtgattgggaatacgcgggggttctcgcccaaagtgacggtaatctcggctatatgtgggaatgtcctgatttctttgaattaggcggcaagcatgtcctgctgatttcgccccaggggatcgaggcggacggtgattcatatcaaaatttacatcaaaccggttatttaatcggtgactatcatgatgaaacaaacaaatttacacacggcgcttttaaagaactggatcacggccatgacttttacgccgtgcaaacattattagatgataaaggacgcagaattgctatcgggtggatggatatgtgggaatctgagatgccgacaaaagcggacggatggtgcggtgcactgactttgccgcgagaactgactttgcgtgatgatcataaacttttgatgaatcccgtggaagaaaccaagcagctgcggaaaatggaatatcgggaatgtgccggacgatcggtttcagggagttacttggcaaagacgtccgaagacctgcttgaagtccgagtcgtgtttgatataaacgattctgatgccgaaacggcaggttttaagattcgcggccttgacgaagaagaacttgtgctgacatacaatctgacggataaaaagctgacacttgattgcaccaagatggggaaagcgaaagacggtgtgagaagggtgcagacggatacaaacggcaagctggcgctgcgtatctttattgacagatcctcgattgaagtattcgccaatcatggagaaacaacgatgacaagccgtatctatccgaatgaaggcagattggggattgagctgttttcggagaaaggcgccgtaaaggttgaggaattcacctattggacgttaaaggacatttggaaaaaaagctgaaatgtgctttttctgaagtggctggaaatgtaccgatccgggggcagtccgcctgaaatggtttttttgtgaaaatcaatgccgttatacgatgcaggattatgctgcatgaggaagctgcataatcctgttgttgcattatcaaaaaagagttgctttctgtgcgtttctttattataatataaaggtatctgattgaaaaaacgtgcgctcgtagctcagttggatagagcggtggtttccggtaccacgtctgtcgggggttcgaatccctccgagcgcgtctcagttaagacgataggaaaaacctcgcagatgttaaatctgtgaggtttttttattttatcttgttttgaaactgttaacgaatgtgtctctgttatgttcggtgccggcaatcagccgcgcactttcactgatccgctgcgcgagagctttttgcgccttgccttcaaagctgttcaatagtgctgaatacacttcatataattcatctttcaacgtatccatttcgaatgtcggtttcagcgttcggcgcactgtctccaattttgtccccgctgcctgcgttattcctgttttcagcatctgccgctgcagcattttcttcattggatcgtccttgtgttctaaaagttcgtctaatgtcggcattatgtatccacctctatcatcttaaccagtttgcgagcatctggtctttttcctgaaattcgtctgctattttatgtaagaatccgccgatctcttcaaggtctgtgatcgctgcctgcaaagaatcaataaacgcctgctcagcctgagtgtcataaaaaatcgggcctttatcgtaagatagcgcaatatcttcaatggtattggtcacgtcctgtgcttgaagctgatcatacaagccgtgtccgacttggccgtaaaattccgttttcagctcggcgattttttcatcgtgttcttgataggcgttttgcgcttcttttttcatcgtccgcaaatcctcagtcatagcctgcaccttttcagccagcttctttgcgtttgtcggcgttacttttattgtatctgcgcttccgattgcaccggccggcagaagagcgccgaggtttttatcaaagactaattcatctccgttcggatttgcgatagttccgtttctgtcgaacacgaaatttgcttcgtttaagccgtgtgtatccggatttctcagaatgacggtagtgaagaaataagcgagattttttccgatctgctcgctcaatttcccatcaagccgctgctttcggctgaactgtgagagagaggggtttttcgtgtaaatcgttgtcccgttgtggcggtcatattcgttccaataacctgccccgaccatgtcgtccggattgataattgaccggatgtaaggatcatatatgccgctgttgatctctttctgtgtttcttcatcgtgcagcttcacgacggaaggactgttaaacgcgacggcatacacatcattattcaccgcgctgtattcggcctcagcgccgccgagtgaatggccggttgttgaaataatcgttgacgttccggcatactttttctttacgctccgtaccagctgatcggcttggtcgatttgcgatgttttcgtcatcagcttatactttccggttgtgagcatggcgtcttgagagggcgttccattgtattttccgagtgtttttgaggtatcctccgcgtcttttttcacaatataatgtacttctgttttcggatcatttccgaaaacaatattgccgccgtccgcttttacgccgtcattaatcgggtcttttccgatatcggttcccgcaaaggcgacgaccacgttttcagggttttttgattttgtccagttaccgttgttcttttcagcttgtgacagaacaaccgcgtcaagtccggtatcgttgtccgattttatttgatcgacgtaccatctggtggaagatttaaattttaatggcttttgtgtttctaagtgattcttaagagtttcataatcataagatacttggcttaaataaaagtattctcggtcactgatatttgttacattgatgtttttagacatgtacaacaccccggagttgatgtaagattaatctaagaaaggatgagtttatgaagaaatacataattatcctaatctctgtaataattatagcattaggaggtatttacatgaagtaccaacatgataaaaaagaagcagaacaagaactttttatccaagcgaaaaataaaatgaaaagctatataaaagctaattacaaaaatataaagcaaattacatacattaacgattataaaataaatcctatgggtggtatttccgtgaaggggtacttgaatggtaataaggaaaaagaatttttcgggctttatgacaaaacgaatgatgaaataggagtttcgtcagtcgatgcggaagagaaacctgagtgtcaggaaaaagaatgtgaatactaaaaaagacgctggaataaagaagtactctggaatgccgcttatatgatcctctgtggacactgaagaaaaatcttaagacgcctaaatgcaccggatgtcaccgaccattttttccagtccgcgagcttcatcataactcatgggagggatgattctgtgaaaaaatacattattatcttcatagttatttttatagcagccggaggctttataatgaagagtatgaatgataaaaatgttcaggctgaagagataaagattgctcaagaacgaatggagaaatttatcaaagcgaattatgaaggcatacataacgttacatttaaagataaatacgaaatagatccaatgggcgggatagaggtatttggctattacaacggtgatacatcgaataaattcgatggtatttacgataaggcaaatgacaagatcatggggcactcaatagacgctgtaataaagaaagaatgcagagataaagattgcgattattaataaagacgctcgtctggtatgagcatacactaaacgaaaaagacaagggttcggcatgtgccgcccttgtcttttttcattgaacattggaaaacataatcagaaacagctcatcatttgacagtccattttaacagcgttacaattaaacgtgtaaatagttacatgtttaaataaacataatgtctcgggaggtgatacgtccttgaatgaaccttctttaaaaaagtcatttatgagtcagtgaaccgcatcattgatcccgagcacacgtatttccgcactgtgcctgtgtttgaaacaagcagcgaggcatatcagcatctgcaggaccggctgtttatcggggctgcggtccgattgccggatgacattcggttagatatttatgaagttcaataataagatggagagtgagtcaacatggaaaactttatcggaagccatatgatttacacgtatgaaaacggctgggagtatgaaatctatattaaaaatgatcatacgatcgactatcggattcatagcggaatggtaggcggccgctgggtgcgcgaccaggaagtgaatatcgtcaagctgacagaaggcgtatacaaagtgtcatggactgaaccgacaggcacagatgtttccttaaactttatgccgaatgaaaaacggatgcacggaattattttcttcccgaaatgggtgcatgagcatccggaaatcacggtgtgctaccaaaatgattacattgacgtgatgaaagaatcacgtgagaaatatgaaacgtacccgaaatatgtcgttcccgagtttgcggatattacgtatctcaacaatgcgggaatcaataacgaaacattgatttcagaagcgccgtacgaaggaatgaccgatgaaatccgtgcgggaaaattaaaataagagaaaaaacccggcagcttggccgggttttttgtatccttttacgacagggttttggtcatgataaagtcgacttgtttatcatcccccatataaaaagagtgttctccggtttggacaaaccccattttttgataaaaggcgattgcattttcgtttttttcccatacgcccagccagatgttctttttattgtgtgctgttgcgattttcacagcttcattcagcagatatttgccaagcccgtgtttctgatggctttttcttatataaattctctcaatctcaagagaatcatcccccattttttctgactgtgcttcgttcatgttgacttttacataccccgcaaggtcattatgataataaataaaataaaattgagaagacggattggataattcctttttcagctgttcagagcggaatgcattttccaaataagctttcatattttctgttgaattttgatccttaaatgtatcattgaatgtttcaatgcttatctcccggagctctgttatatcgttaaggctgcacttttttaattgaatactcatggtcatacagctcctttcttcatttatcatatcagctgtttttttgttgtgtttgcaatgaaaataccgtatagtaaacataccgtatttttgttgtatttgcaacataaaataagaaaatgaggacgataaagtgaaatatgttttttatgttttaggaatcatgatcttgacctttggtatttctgtcacgattcaatcagatcttggaacgtctccttttgatgcgcttattgtgggattatccgtccatgcagggcttaccgtgggaagctgggaaatcatcatcgctttcctgttaatttgctgtaattcaatgttaaaaaggcaaaggccggaattttcagggatgattacggcgtttataacgggaatcgggattgatatgtggcttttttttctgcatcgagtcataacgcctgaactatggtacggaaaagcgggctgttttgcaatcggtttagttgtgatagggataggaaccgcaacctatctgcacacaaatttcgccccgatcccggttgatcggttaacgctaattgtccgcgatttaaccgggagaagcatctttttttcaagaacggtcatttacttcatatttttcatactggccgtgatgctaaaaggtccggtaggcatcggaacgttattaaccgtttgtttaggcgggatcatccttcatttctttatgccgattaccggaagatggatagacggcatattaacagcatctccaaagcaggaagaaacgaaaacccggtagcaggggtttttatccggttctatcatttttcatttcatccgcatgttcaaggtataataaaaaagggggagggatttttatgagcggtcaaagaaagctcgttttttacggagctgtcagcgcagatggctatcttgcgcgggaaaatcactctttagattggttaatcggaactgaaggtgaagacggcaccgattatgaagctttctatgaatctgtcgatacgatcatcatgggcagaaaaacatacgaagaaatattggttttattgcctgaggaatttccgtacaaaggtaaagaatgctatgtgttttcgcggacattgaccgggtgcactgaacatgtgcggtttattcatgaagagcctgccgattttataaaagcattgaaacgccaagaaggcaagcggatttggattgtcggcgggagtgatctgctgcacccggttttggaggaaaaacttgtcgatgagtttatcattcagatcgcccccgttctgctcggccgcggaatttctttgttcaaacccggagaccgggagacagggctgaagctgactgatgtcaggcgctataagcaatttgcggagttgcattatgaagtgagatgaaatgaagtgtatgaaagaaacccagtaaaggttaccgggtttctttttcatgtttgtttttatgttttgaaatggagtgggccggcccgcatgaaaatcctgcaaccatgataacaacccctatccacctcacggcatagaaatcagtgtcgcgcaggaatattaatgaaactaaggtcataagcgccccgattataacggcagctgtgccgataatacttgatttctccatataaaaactcctttatgaatgtttggttaacgtattgggttagaatataacatatcagggtaatgcggaaatggattttctgcgatgtctgaagtaagatgaaaacgaaacgccaagggagccggctcccttggcgttttttatgcttgaaacaagatgcggcgttttgctgaatcgggatcactttcgacagcggtatccgtgttgaaaagcaaagtttcgcgtgaatcggtatcatattcaggccaattgaagtgagaggtgttcgggtttccggtttttgcaaaagcgagccatgcggattggatttgtttggaaagctgttctgcgtcatcaccgagcggttcttgcagcgtctttctcaaagaatcaaagtttccgaacacaaacggcaattccagagcgtgaacggctttatgaaacggcggtgtttcgccatgccaatcaaagcggtacatccagaccggtgcgtgctgcgactgtccttgtgcgaaagcgacagccggccgccagaaaatcagatccgtcatcatatcgatttgtccctttaatgaatgcggatataaatctgccgcttgctcggtgcagttctctccgaggtaataatgcaaataatcttgctgctttttctcggaatgaatgtctgtatcaggggtgaaaaacaaatatgcttcatcacgattggttccgatgatcataggtatgccttctgcggccccgtctgctatggctttcaccgattccgcaggcaatgtggccggatcgatggcgggctgaaacaaaagctgaaaaatgttttgatctagtgagcgccgcactttatccgcagtcttaagcaggtcattaacggaaagctcctgcaattgatcagtgccggcttcatgaataaatgccgccgcgatgtcttttgccatgtccgccgggatcgtatgagaggcgccgctttctaaaatggctttatgaaacaggccttttgcgtcaggcattgccataagggaggcgatgctcatgccgcctgccgattcaccaaatatcgtgacgttatccgggtctcctccgaattcggagatattgtccttcacccagcgcagcgcggcgatctgatcgagcagcccgatattggaggaatacgcgtcatgaatagaagacaaatgtaaaaagcctaacggtccgagcctgtaattgagtgtcacgacaatgacatctccgtcagcggcaagggcagatccgtcgtaaagcggttcgcttccggcacctaaataaaatgccccgccgtgtatccataccatgacaggctttttttcgccctctgaatcgggggcgaaaacattgaggtaaaggcaatcttcagattgagccggtatatccccggaaaacgatatagacagcatatcatccggctgcggacaaatcggcccgaacgagtcggcatgttttacgccgtcccaaggtgcgggcggctccggcgctttaaatctgagctctccgacgggcggcttcgcgtacggtatgcccttccatgtgcgggcaccgcggccggcagttcctttcagtgcgccgcagcgggtttgaacggtaagttttgtcatgatttcatccccttttttcttttcattataaacagagatgaaggcatgaagcgaataaaagccctttcatcagcatatcatcagtaacgcttccgttctaaaaatgatctgacttcctgaacggacaagccgagttcttttgcttcctgcatcagcgctttccattcttcaatgttggattcagtcagttttctgttacggtagggtgcgggctccgggcgtttttcagtcagtttgttcgtaaaggtgaacagttcttctttcggcatgcccgactgcacggcctgcacaaggtggatgcgccactcatcttccgtgtctcccatctgatgcagcatcgtttcggcatcaaaaagctccgtcagatcgacctgcagggtggcggatacttttttcagaaattggatggacggatttgagtgaaccccccgttctattttgcttaaataagatttagagacacctgcttcaactgctagctgattaatagagtagccttttcttctgcggtataaacgaattattcttccaatcattgtgctgaattctcccctgtatactggcattttttgttcattataagaaatttttcgttctttataaaatttaaaattataaggtaagtgcagtaaataagaggaaaatcatgataatgttctctaaaaagaaccaaatggcttaatttgaaattttcaaatttcgaccttttcttttataatccaatcattaacagaagggggcgtttaagcctgatgcaataaggatgaggctgtaattacatgaatgagaatatgagttttaaagaattatttgacattattaaacacagacttttactgatttttatcatgacagcagttgtaacgctggtgacgggatacatccaattccgggtggtttcgcccgtttatcaggcatcgacccaagtgctcattcatgaaacaagcggtgaaaaaaattcgaatctcagcgacgttcagctgaatcttcattacaacaatacgtttcaaacgataatgaaaagcccggttgtgcttgagaaagtgaaacagaagctgcatctttctgagacggcatccgctttaaaagcaaagatcacgacaagcagcgaaaccgattcagagatcattaccgtagcggtgcaggacgagaacccgaaacaggccgccgctatagcgaacacgctgatgaagacatttaaaaaagaagtccgtgacaggatgaatataaaaggcgtcattgttttgtccgaggcaaaagcatcggaaagcccgatggtcaagccttcgcgcatcaggaatatcatgatggcgttcggtgcggctctcatggcgggtgtgacgcttgcgttttttctccactttcttgatgaaaccgttaaaagcgagcggcagctcagcgaaaaaacagacttgcctgttttaggggttgtgtatgacatcaaaaatcagcagacacggtctgatgaaaaacatttcggggagtgaggcgtttgggattcagaaaaaagaaatcaagaaggggactggctcaaatatccgttttacatcacaaatcattggtggctgaacaataccgcaccattcggacaaatattgagttctcctctgttcagacccatttgcgctctattctcgtcacttcctccgttccgggagaaggaaagtcattcagcgccgccaaccttgccgcggtatttgcgcagcaggaaaaaaaggtgctgctcgtcgatgcggatttacgaaaaccgacgatacacgagacctatcagcttgaaaatgtacaaggccttacgaatgtgttagtcggaaacgcttccctcggcgaaacggtgcaaaaaacgctgattgataacctttacgtcttaacgagcgggccgacgccgccgaatccggctgagcttttatcttcaaaggcgatgggagagctgattcaggagatgtacagccggtacagtctggttattttcgattcacctccgcttttggcggtggcggacggacagattttagcgaaccagacagatggaagcgttctcgtcgtcttgagcggaaaaacgaaaatggataccgtccaaaaggcgagagacgcgctccagcagtcaaaggcaaagcttttgggggcgctgctgaataaaaagaaaatcaaaaaaacggagcactactcgtattgagcggtgcaggtgatgtctccttacctttatcaacggaggcactcggctctgctgtgggcggcgtttttcgccgccttagatgctggtcgtcggtggcggggtgtgaggacgggttaaatgcccaatttatcttaagatgatgcattgttatcggcttagctgttatgtctgtttttacgaaaaccgtatcagctaaaccgataaatgaggaggggaaagattgacttaccggagaagactttcaatgatttttgcattggatacgtatctcgttttactttccgttgttataggatatcaattttttgaggattcttatcacttttatgactccggagcgttgctgctgactgccgtgagcatgctgatcagccatcatgtatgcgcttttatgtttcaccagtataagcaggtatggacgtacacgggaataggcgagctgcttgatctgctgaaggggatcacgctgtccgcagctgtgacagccgccgtccaatacggggtgttccacacgattttgttccggctgttggccgtcagctggatggttcagctattgttcatcggaggaagccggatgatttcacgggtgctgaaagaaacgatcggcaggaagcaaaatgactcttcccgggcgctgatcatcggcgcaggtgcgggagggacgctgctcgtccgtcagcttacccagaaaaacgatctcggaatcatgcctgtggcttttattgatgatgatcagacgaagcataagctcgaaatcatgggcctgcccgtcatcggcggaaaagaaagcattatgccggcggtgcagaggctgagaattcaccatattatcatcgccattccgtctctttgcacccatgagcttcagacgttatacaaagaatgtgtgcagacgggcgcccatattaaaatcatgccgcaatttgatgagatcctgctcggaacgcaggctgccggacacatcagggatgtaaaagccgaagatctgctcggcagaaagccggtcacccttgatacgagcaaaatttctgacagcatcaagggaaaaacgattctggtcacgggcgccggcggctcaatcggttctgagatctgccgccagatcagcgcgtttcttccgcgggaaatcgtccttctcggccacggggagaacagcattcattccgtacataccgagctgtccgcacgcttcggcaaagaggtgctctttcacgcggagatcgccgatattcaggacagagataaaatctttactttgatgaaaaaatacgagccgcacgtcgtctatcatgcggctgcccataaacatgtgccgttaatggaacataatccggaagaagccgttaaaaacaacatcatcggcacgaaaaatgtcgccgaagccgccgacatgtgcggaacggaaacattcgtgctgatttcttctgacaaagcggtcaatccggccaatgtcatgggcgcgacgaaacggtttgcggaaatggtcatcatgaacctcggaaagatcagccgcaccaaattcgccgccgtccgtttcggaaatgtgctcggaagccgcggcagcgtcattccgattttcaaaaagcagattgaaaaaggcggacccgtcaccgtcacgcatccggcgatgacaagatattttatgacgatccccgaagcgtcaagactcgtcattcaggcgggtgcgcttgcaaaagggcggcagattttcgttctggatatgggagaacccgtcaaaatcgtcgatctggcaaaaaacctgattcatttatcaggctatacgacagaacagattcccatcgaattctccggcatccgtccgggagaaaagatgtatgaagaattgctgaatcataatgaagtacatacggagcagatttttccgaaaatccatatcgggaaagcggtggacgggaattgggccgtgctcatccgttttatggaggaattcagccgtctgcctgaagaagagctgagaaaaaggctgtttgaggcgattgaatcagtacatgaagaagcggccgcaggcgtgtgatgggaggacagaaagatgacgaaaaaagtattattctgcgccacagtcgattatcattttaaagcctttcatcttccgtattttcaatggtttcaggatatgggctgggaggtgcacgtcgcggcaggcggcaatatgaatcttccgttcgttgatgaaaagttttccattccgatccggcgctcgccgtttcatcccgaaaatctttctgtttacaggcgtctgaaacggctcattcaggacaacggctacgacatgattcactgtcatacgccggtcggcggcgtgcttgcacgccttgcggcgagacaagcgcgccaaaaagggacaaaggtgctgtacaccgcgcacggctttcacttctgcgacggagcgcctctgaaaaactggcttctttattacccgatcgaaaaatttctttcttcttatacggattgtctgattacgattaatgaagaggattacgaacgggccaagcaaatgaaaaaaacagattgcagcgcgaaaaaaatacacggcatcggggtgaatacagacaggtttcgccctgtgagccgggaagagagtgaacgtctgagagaaaaacacggcttcggcgccggggaatttattctcgtataccccgctgaattaaacggcaataaaaaccagggacttctcattgagactgcggcactgctgaagaaccgcatcccggagctgaaactcgtatttgccggagaaggcgcgatggaagagccgtacagaaaaaaggctgaatcactcggtgtatccgacatggtgcggttttacggtttttgccgcgatattcatgaactgattcagcttgctgatctgtctgtcgcctcaagcatccgcgaaggactcggcatgaatctgcttgaaggaatggctgccgaaaagcccgccgttgccgcggacaacagggggcaccgcgagatcatcgaagacggcgtgaacggttttctcgtgccggcgggggacagcgcggcgtttgccgatcggattgaaaagctgtaccgctccccggggctgcgaaaagcaatggggcaagaagggcgcaggacggcggaatgtttttcagaaacacgtacggtaaaggaaatggcgcacatttacgccggttatatggataaaaaggagaaaagcgtatgaatgcaggagcacaaccgaaaatttccgtcatcatgggaatttataattgcgaagagactttagcggagagtattgaatccatcctgagccaatcttataagaattgggaactgattatgtgtgatgacgcgtcaactgacggaacgtatcagattgcgcgccgttacgcggatcattacggcgaccggattacgctgattcaaaataagacaaatcaacggcttgccgcttcgcttaaccgctgtctgacatacgcaacgggggattatatcgccaggcaggacggtgatgacatctccaaccccaggagactggaaaaacaggccgctttcttaaacaagcacgcccactatcaagtcgtaggcacgggcatgctcgtatttgacgaattcggtgtaaggggcgcccggcttttgccgcccgtgccgaaaccgggaattatggcgaaaggcacaccgttctgccacggcaccattatgatgcgggctgaagcgtacaaagcgcttggcggctaccggtcagtcaggcggacgcggcggatggaggatattgatttgtggctgcgcttttttgaagcgggtttccggggatacaatctccaagaaacgctgtataaagtaagagaggacagtgatgcgtttaagaggagatcgtttacgtattccattgataatgcggtgctcgtttttcaggcctgcagacggctgaagctgccgctttcccattacgcgtatatcgcaaaaccgctcatccgcgccattacgccgcccgcggtcatgaaccgttatcataaaaacagggacatccgccaaaaagaagggcttgccgaacatgactgacaaaccgatacgggtgctgcacatcttcagcgggatgaacaggggcggcgcagaaacgatgatgatgaatttgtaccggaagatggacagaacgaaggtgcagtttgattttttaacccataggaacgatccgtgcgcttatgatgaggaaattctcgctctcggcggacggcttttttatgtgccgagcatcggcagcacaaacccgattacatttgtaaaacaggtcaagcgggtgattcaggaaaaaggcccgtttgccgccgtgcacgcccataccgattttcagtcgggattcatcgcgcttgcctctcgtttagccggcgtcccggtgcggatctgccattcgcacagtacgtcgtggcgggggcgggcgtcgcggcttgccgggatgcagctgtttgttttcagacggctgattacggcaaacgccacggcactgtgcgcctgcggaaaagacgcgggccgtttcttattcgggaaagaaaaagacgtgcatcttttgccgaacggcattgatctcgacttatttgccggcgggtgcgcggacacagaagctgaaaaaaggaagcggggcattgcagacggccgtttggtgatcggccatatcggccgctttacagaagaaaaaaaccacgaatttctgctccggctggccgctgatatgaaagagcggggcatcggtttacagctggttctcgccggggacggtccgcttcgcaccgacatggaaaatttggcggcgaagctggggcttgatgatgatgtgcgttttatcggcatagaagaacgcgttcatgccctgctgaaaacgctggatgtatttgtcatgccgtctctttatgaagggctgcctgtcacgctcgttgaagcgcaggcctccggggtgccgtgcgtgatatcagacggcataacggaagaagccgatgccgggctcgggctggtcaaaaggctcagccttaaagaaccgccccgacaatgggcatccgcggttttacgggcagcagaggcggcaaagcctgacggggcgcgcattaaagaaaccctcagacggcagggatatgacgcgggagaaaatgcgggggctgttatgaagctttacaatatgaattggaaaaaggaacagtaacgaatgattgtatacgtagtcaatatgggaattgtgtatatttggtcatggttcgcgaaaatgtgcggcgggcgtgatcaatcgctttcgaccggataccggccgaatcagctcgtcatgatcgttccgctgctatcgctcgtattggtctccggtttgcgctacagagtcgggacggattttcagacgtacgcgctgatgtacaagctggcgggaaattacggcagcatttgggagatcttcgggttcggagcgaaaaaagcagccgttgatccggggtttacggctctcatctggctcatgaattttatcacgaaagatccgcaaatcatgtatttcaccgtggcggtcgtgacgtgcagctttattttaaaggggctcgttgagttcggccgtccgtttgagctgagtgtgtttttgtttttgggcacgtatcactattatgcttcctttaacgggatcaggcagtatatggtggcggccgttttgttttgggccgtccgctacgtgatcagcggaagctggaagcgttatatgtcaatcgtgctgctgtgttcgctttttcattcctcagcgctgattatgattccggtttattttctcgtcagaaaaagagcctggtcgcccgcgattttcggactgtcggcattgtttcttcttatgacgtttctgtatcagaagttcatttcgctgtttgtcgtcgtgctggaaaacagctcgtacggccattatgagaaatggctgatgaccaatacgaacgggatgaacgtcgtaaaaatcgcggtgctgcttctgccgctgtttttggctttctgctatcgggagcggctgcggaagctctggcctgacattgatgtcatcgtgaatttctgtctgctcggcctgctcttcggtcttttggcgacaaaggatgttatttttgcccggtttaatatatatttcggcctgtaccaaatgatcctgatcccttattttgtgaggatttttgatgaaaaatcaaatgcgctgatttatatcgccattattgtctgttattttctttacagttacttgcttatgccggtcgattcgtctgtgcttccgtacagaacgattttttcccggtaatggacactggaggtttatatggaaacacccgcggtcagtttattaattgctgtgtataatacggaaacttatttagaaagatgcttagattcattgctcaatcagtcgctcgccaatatcgaaatcgtggccgttaatgacgggtcaacggatcaaagcccggcgattcttgaaacctatcagaagcgggatgagagaatcagggtcattcatcagcaaaaccgggggctcggcgcggtccgcaacaggggaatcgaggcggcgcgcggcgaatttatcgcttttattgatgcggacgactgggttgaacctgattattgcctgcgcatgtataaaaaagcgaaggctgatcaggcggatctcgtgatttgcgaatatgcggccgaatttgcggatacggggaaaaccgccgtttcaacgatcgcttcagcgtacgcgggccgcccgaaacaacggtacctgaaagatttatttgaaggaagagtcagcggtttttcatggaacaagctgtacaaaagaacgatgatcgagcatcatcagctgcgctttccgcttcgtgatgagctggagcacgtggaggatcagtacttcagcctcagggcgcatgttttcgcaggtgcggtctcgtacgtggatcagccgctctatcattatcggattcacttgacttccattgtgcaaagctatcagaaaaagctgtttgactcaggtctcgttctctatcggctgaacgaggcttttttgcgtgaaaacggctgcttacaggaataccggcaggagctggattttttcatcgttcagcacggaacagtctgcctgctgaatgaatggaagcggaataacggcggccggttttctgagaagtggaagaatatcagccggatatgcgctgatcccgtgtttcgcctgagcctttccaaaaccggaacggcgccgtttgacgccaaacgctcatgccttctgcttttggcgaagctgaagctgattccgttcgtgtcgctggcatcagccgcgtatcagcgggcaatcgagtacaaaatgaaaatcagagggtgaagacatgtcgatacaatctttaaaaatcaatcttgcggaatggctgttgcttaaggtcaaatacccgtcccaatttcatttcggaacggcagcggatgggtcggggctttcagcggcaagaaaaaagatcattctgacgctgctcccgtcccacgataatctcggcgatcacgccatcgcctatgcaagcaaaacgtttcttgaacgggagtatcccgattttgacattgtcgaggtggatatgaaggatatatacagatcggcaaaagcgctgatcaaaaagcgccactccgatgatatggtattcatcatcggcggcgggaacatgggggatttgtaccggtatgaggaatggacgcgccgctttattatcaaaacattccgggaatatcggatcgttcagcttccggcgacggctcacttttctgaatcaaaaaagggacggaaggaactgaagcgcgcccgaaaagtgtacaatgcgcatcccgaccttttgttaatggcgagagatgagacgacgtatcaatggatgaagcgtcattttcccggaaaaacagtgctcaaacagcctgacatggtcttatatttggataaaagcgagcggcgcaccccgcgggaagggatctacctctgtttacgggaggataaggagagtgcgctgacggctgaggacagaacgatggtaaaagaagctttggcaaaagagtacggcgagctgtattcctttaccacgacggtcggccggagggtcagccgccatacacgcgaaaaggagctggaagcgctttggaatacgctgaaaggcgcggaagccgtcgtcactgacaggcttcacgggatgattttttgtgcgctgacgaaaacgccttgtgtcgtcattcgttcgtttgatcataaggtgatggaaggctatcaatggctgaaaaacataccgaacatgacattgcttgagcgtcccgaccctgaagccgtaacgtccgccgtaaaccggatgctcagcggcaagcatgaggaaggcggttcattgcgaagtgtttattttgccgggctgcgctcgaaaatcagcggtgatgcccaatgaccgcgccgcttgtgagcgtgatcgtgccgatgtataagacagagccttttattaaagaatgcgcggtttctttaacaaaacagacgctgagagacatcgaaatcattttcgtcaatgacggttcaccggatcagtcaggccgtattgctgaacaattcgccgcagaagatgcgagaatccgggtgattcataaagaaaacggcggcctcagctcggcccgcaatgccggaataaaagccgcccgcggccgttatatcggttttgcggacggcgatgactatgtgacggaaacgatgttcgagcggctttatgaagaagcggagaagaaccggctggatatcgccggatgcggctattataaggaaacgccgtctaagaaaagaacatatatgccgccgtccattccggcgggccgcgtcttcacagcggatgaaatgactgcattgctgacccgcgcgcacgaacatcggtttatttggtatgtgtggcgctatatataccggcgagaatctttgcaaggactgttgttccatgaagatatccggtttgccgaggactctccgtttaacttggcagcgttccgccaagccgcgcgtgtcaaagtgatagacgaagggctgtatatctaccgggaaaatccgcaaagtcttacagaaaccccgtttaagccccgcttagatcacgaactgcaaaagcaatataaagcgaaaatggctttttatgaggaaaacgggctgacggacgcctgccggagcgatattgatacgtatttgtgcaagcatcagattccgatgctgatcgccaacgcatgcgccgccccgcagccgtcacatcagattacggcgcatatcggcagaatcttaacgtatgacatggtaaaaacggcggtgcgcagcacgccgtgccggcataaacagctgctggcgggggagcgcgtggtgctcggcctgtgcaaaatgcgccttcctcttcttctgcatgcgtttttcgaacggaaatcgaaagagaaaggcagtgcggaaggagcatgaaatttgccattaatttcggcgccaatgtgacggcgtttttactatcggtgtttttatcagtgtggatgacgccctttattgtgaaaacattaggtgtggaggcttttgggtttgtccatctgacacagaatatcattaactatttctctataattaccgttgcgctgagctctgtcgttgtgaggtttttctccgtcgccgcccacagggggaacaaggacgaggccaatgcgtatgtaagcaattatttagccgcgtctgtcgtgatatctctattgctcgctgtgccgctcgccgggacggctttttttattgacaagattatgaatgtaccggccgggctcttaacggatgtgaggctctctatcgtgatcggcagcgtgctgtttatgctgacgttttttatggcggggttcgcgacggggccgtttttcgccaacaagctttatatcacaagctccattcaggccgtgcaaatgctggtcagggtgctgtgtgtgctcgctctgtttacgtgcctgccgccgaaaatctggcagatccagctttcggcattagcgggagccgtctgtgcggccgtgctgacttttttcttttttaagaaattgattccgtggttttctttcagccgtaaaaccttgtcattacagacgagcaaagtgctgttttcggccggtgcctggagttctgtcaaccagatcggcgtgctgctgtttctgcagattgacctcatgacggccaacctcgtgctggggccgtctgaagcgggtgtctatgcggcgattattcaattcccgctcctgctcagaagtcttgccgggacgcttgcttcactgtttgcgccggttttgacttcctactattcaaaaggcgatatggaaggtctcctgtcttacgccaataaggccgtgcggctgaacgggcttctcctcgcgcttcccgccgcattattaggagggctcgccgaaccgtttctggcgatttggctgggcccgtcgtttgtgcagacggcgccgcttttatacattcacgccgcgtatttggcggtcagtctctctgtcatgccgcttttttacgtatggacggcttttaataaacaaaaaacgcccgccgtcgttactttatgtttaggcggactgaatgtcatattggccgtggttctcagcggaccggctcatctcgggctgtacggcatcaccatcgccggtgcagtctcgctcattttgaaaaatgccgtcttcacgccgctgtatgtttcgcatattaccggttttcagaaaaccgcgttttacaaaggaatgttcggcccgttggcggcggccgtatttgcctgggctgtctgccggggtatccggctgttttcaccgcttgacagctgggccggcctgatcgctacggggcttgccgtatgcatgagctatgccgcattcgcttttttcttcatttgtacgaaagaagaaaggcggcttgctttacagaaatgccgaaaagtgaaaggagctgttcagatttgaaggcgaaacgtgtatttgatatagcggccgcggtgttgttattgtgcggcgcgagcgtcatccttctcttcgccatggccgccgtcagatgcgccatcgggtctccggtattgttcaaacagacgagaccggggcataacgggcgtccgtttacgttgtataaactcaggacgatgacggatgcgcgtgatgaaaacggtgtgctgcttccggatcatctgcgcctgaccaaaacgggaaggctgatcagaaaactgagcatcgatgagcttccccagctttttaatgtgctcaaaggagatatcagtctggtcggcccccgccctctgctgatggattatctgccgctttacacggcggagcaggcgcggcgccacgaggtgaagccggggattacgggctgggcgcagattaacgggagaaacgcgatttcatgggaggaaaaattcaagctcgacgtgtggtacgtcgacaaccgcacatttcttctcgacttaaagattctgcttttaacagtgaaaaaagttctcgtgtcagaaggcatacatcaagccggccatgtgacggcaaagcgcttcacaggcagcggagatatgtcatcgtgaaaaaggtcgtgctgatcggaaacggcggacacggaaaagtcgtgaaggaaatcgtgcaggcccgttccgatatggagcttgcgggcgtattggatgacggattcagcggttttgccgttcggaacggtttatatacgggccggacgaaagacgtgcccatgcttcggaaactcgtccccgaggccgtattcacgatatgcatcggccgcaacggcgtcagaaagcagttcgctgaaacgattgggcttgaagatgacgattatgccgcactcattcaccccggggcgatcgtcagtgaaacggcttccgtcggacacggaacggttgtgatggcgggcgccgtcattcaggcgggcgctgacatcggcgcccattgcatcatcaatacgggcgcggttgccgatcatgacaatgcaatcggagattacgtccatctttcaccgcgcgcggcgcttgccggcggagtgaaagtcggggaaggaacgcacatcggaatcggcgcgtccgtcataccgcagattgacatcggcccttggtccgttatcggcgcgggggctgcggtcatcagccgaattcccggccatgtgacggcggtcggcgttccggcccgcgtcatctcccctatccataatgaaaaaggatgatttcatgcaaacaaacaaacggatttatttgtctccgcctcatatgagcggaaaagaacaggaatacatcgcagaagccttccgctccaattggattgccccgctcggtccgctcgtcaattcgtttgaagcgcggctcgcggaatatgcgggagtgaaaagcgcggcggccgtaagctcgggaacggcggccatccatcttgccctgcggcttgcgggtgtgaaaaaaggagacgctgtattttgtccttcctttacgtttgtcgccacggcgaatccgattgtgtatgagcaggctgagcccgtttttattgattcggaatgggagacgtggaatatgtcgcccgatgcgcttgagcgggcgctgcgggatgcaaaacggcgcggcagactcccgaaagcggtgatcgccgtcaatctttacggccaaagcgcgaaaatggatgaattaatgagcctttgtgacgcatacggcgtctgtctgattgaagacgctgccgagtccttaggatcaacatataaaggcaggcagagcggcacgttcggccgtttcggcatttattcctttaacggcaacaaaatcattacaacatcgggaggcggcatgctcgtgtctgacgatgaagccgcgattgaaaaagcgaggtttcttgcgtcacaggcgagagatgccgccgttcattaccagcacagcgagctcggttataactacaggctcagcaacattctcgcgggcgtggggatatcgcagctggaagtgctcgaagatcgcgtccgggccagaagagaaatctttcacaggtatcgggaagcgctggaaacgtatccgggcatccgcatgatgccggagcttgaaggaacggtttcaaaccgctggctgacggctctgacgcttgataacggcgtgacgccggaagaagccgtcacctgtcttgcggaacagaatattgaggcccggccgctgtggaaaccgctgcatacgcagccgcttttctcatcttccgtcttttatcctcacagcgaacatgagcgtgtctctgagaaccttttcagccggggcatctgtctgccatccgggtctgacctgtcttctgaggagcagcagcgtgtcattgacgcacttgcgcaactgtttgaaacgaaaggggagaaaacatggacagccgccatgttatgagccgattaaaagaaacgctgacgggtctgctcagcgttataccgccgcaatctgacatcatatatgccgactatcccctctacggaaatgtaggggatttattgataatgaaagggacggaggcgttttttaaagcacacggcatctgcgtgaaacagcgctggaatcccgacaattttccattcgggcgccgggcggacaaaaagacgatcatcgtctgtcagggtggcggaaatttcggggatctctatcagtactatcagacgttcagggaaaaaatcgtcaaatccttcccggaaaacaggatcgtcatcctgccgcaatccatctattatcaggatgagacacggcttgggaagacatcggcgctttttgcggggcacaaggatctccacctgtttacgagggatcatgtgtcatacgagaccgcgaaacgctttttttcggcgaatcatatcgggcttatgcctgatatggcccatcagctgtatccgatcgcggcgtcagcggctccgtcacgcggcaggcttcattttatccgcacggatggggaaatcaatccgaagctgcaaaacaatccttccgttaaaagctgcgactggcaggatgtgctgtcagcaagcgaccgcaggggaatcgcttttttccaaacactgaatgttttgaataaaaaagcgggaaacccgctgccgattgcgcggttttggaaacgctattccgatttcttgacgaaaaaagcggttctgtttttcagcaggtacgaatcggtggaaacgtcaaggcttcacggccacatcctgtcctcgcttctcgggaaaccgaataccgtcattgataattcatacgggaaaaacgccaactattattacacctggatgcacgaagcgccggacgtccgtctgatcggggaaatcgccggcacgaaggaaaaccttccgctttgaatgagcggaaggtttattttgtttctccgcgttttactttgttgtacgcctcatccaaatgctgaattcttttgagcacaaccgagtttttcgtcagctgatcctgaacaagggttgagacgacggagcggtaatagctgttcatcgcatgaattcggtcttcattcggattcatttcaatgtgctgtgtaaagttttcaataaaataaggaacagaaaaaagttctgacatctataaagcaactccttttaataagtatatacggtatgaaaccaatcatgtacaatgaaaaaaggggagtgagcatgatggatatcaaacttcagcaaacacaaatgttaaagcctcaattaacgcaagagcttaaacaggctatcacattactcggatacaattccgcggaactggccggatatattgatgagctctcactggaaaaccctctgattgaacgaaaggaaacagacacgccgccactatcttaccataaaacaaataaaaacaggatgaaagaacgggacggaagccagcagatcagacatacccgcaaaacgctgcaggattcgctcaaacagcaagccttagacatgaagctgtccgatgatgagaaaaagattttcaattatctgatacattcattggactcaaacggatatttaaaagaggacataccagctgccgccgaccatgtatccgcttcacaagaggagacggaagcggttctgaaaaagcttcaatcccttgagcccgcgggaatcggcgcccggtctttgcaggaatgcatccttcttcagctccgccgtcttcctgagcggaacgaacaggcggaatggattgccgaagcctattttgagctatttgcaagaaagaactggaaagcgcttacaacaaaaacgggcattccgcttaaagacattcaggacatcgctgacatgatcagcgcccttgatccgaggccggggctccgttatgcgcatgaggagccgggtttttacgtggaaccggatattttcatcacagtgaaaaacggcatcattcaagcgcggctcaacagccgttcgtttcctgacatccagcttcatacccattatcagccgctcttgtcagctgccgggtgccgtgacacgaaaaattatctgtcggcaaaatatcaggaatggcgctggctgaaccgggctttgtcgcaaagaaaacaaacgatcacgagaattatcggcgtcctgactgaacggcaggaatccttttttctcacaggaaaaagcggaatgcagccgctgaccttaagagaggtggcggaaacgctggagctccacgaatcaacgatcagccgggccatcaaagggaagtacgttcagacgccgtacggactgtatgaaatgaaaacatttttctcggcgaaagctgaatcatcgggggacggcggcgcctccaattatgccgtaaaagcgcatctggaggaattggtccataaagaagataaaaagaaacctttttcagaccaaaagcttgccgatctgctgcatgaacaatatgacatccgaatctcaaggcgcaccgtcgccaaataccgtgaccaattaaatattccgccgtcatcggcgagaaaacggtacagctgaaacctccccgagccaaaccccggggaggttctccgtgttacgggatcatccatgaaaacagatgatgctgtaaaaatgtaatgagacagacgagcagaagcaaaaacagactgtgcttaatcgtaaagcggaaaagatcggcttccttgcccgccagaccgacagcggcacaggcaaccgcaatggattgcggagaaatcatttttccggtgacaccgcccgatgaattggcggcgacggagagaaccgggtccatcccaacagagagcgccgttaccttttgcaatccgccgaacaataggttggccgatgtatcagagccggtaataaatacgccgagccagccgagcaccggcgaaaaaaaggtaaacatcgcgcccgtcatggcaagcgcaagaccgagtgtcgtgctcatgccggaagcattcgtcacataagcaaagccgacaacagaaacaatggtcacaaccggaagcgttaactctttcaccgtttcaataaacgcttcgccccacgtcttccacgacatgccgagggcgaacttggagatgacggcggcaatcagaatcgccgtccccgctgaaccgaaaagctcaagcttgtatacggcttcaatcggcgtgccgtccgcctgaagaatctgctgatttacaaatgggacgggaggcgtgaaggtcaatgcgcgcccggctgcattcagccaggaaagccacattgacgttccttcataatgaccggttaaggcagccttcacgccgggaatcccccaaacggatatcatggccgtcagaagaaggaaaggagaccacgctttaaacaccgcggcgcccccgtacttgatcggcgcccggtcagcggccgctgctgattcccgttctgcggcgaaacgaaaggccgttttcggtttccaaaatttcaaaaacagagcgagcgcggccatggaaacaagcgccgacagcacatccggaagctcgggccctaaaaaattcgagcttgcgtactgcacggccgcaaaggagacgccggaaacaagaatggccggccatatctcaaaagcctttttaaacccgctcattaaaatgattaagtaaagcggaataaagacggataaaaacggaagctgccggccgaccatttgggaaatttccattgcaggtatcccggtcggaccttcgacggcggtaatcggaatgccgatcgcaccgaaggcaacgggggccgtattggcaatcaggcaaattcccgccgcatacagcggctgaaaaccaagtccgacgagcaaagcggccgagatcgcgacgggagcgccgaaaccggcggcgccttctaaaaacgccccgaatgaaaaggcgatgagcagcgcctgcaaacgccgatcatctgtaattgagagcaccgaactccggataatctcaaactgtcccgttttcacggtgattttatacagaaagaccgatgtgacgataatccagccgatcggaagcagcccgtacaccgctccctgagaagcggacatcaccgctttttccgccggcatgccgtaaacaaatacagcgattaaaagtgaaacggctaacgtgaaaagccccgcgatgtaccccttcatccgtttcaccgcaagcgcccaaaaaaagaagataatcggcacgagcgcgcaagctgccgataaaagcaaatttccccctaaaggagcgtacccctgtgtccattgcatccctaaaaaacccctccttatgtcatgtaagcgattactttttatgataaggtcatctgatgaccgggttaattagcattatattttgaaagttttgaaagtacaatacttttcttgaacaaattgtctgaacctgtcggcggtgcgaaaaaagaagtataatagacgataaacatcaagattcacaagtgacggggtgatcgcgttgaaatataaacaaattaaaacgaaaaaaatctacgaagaagtcgctgacgcattgctggagaagataaaagcgggcgagcttaagccgggtgaaaagcttgattccgttcaggcgctttctgagagttttcaggtcagccgctcggcggtcagagaagcgctgtcggctttgaaagcgatggggctcgtcgacatgaagcagggagaaggcacatacataagagaatttgagccgtctcatgtttcccagccgctttcttccgccctcttgatgaaaaaagaggacgtcaaacagctgctcgaagtcagaaagctgcttgaactcggcgtcgccgccatggccgctgaaaaacgcaccgaagacgatttacaaaaaatccgccaagctctcttggagatgaaagacatcgacggagatgaagaattgggcgaaaaagcagatttctcctttcacatggcgctggcggaagcatcacaaaacgggctgcttaagcatctcatgaatcatgtctccgcgctccttttggaaacaatgagagaaacgagaaaaatttggctgttttctaaacgaacgagcgtgcagcgattgtatgaagagcatgaacgcatttacagcgccgtcgccgctggagacgcggatgaagcggaagcggcgatgacggcgcatctgacgaatgtggaagaagtgctgggggcttattttgaagaaaatgtatagaagctgacttgtgaaaggggataacatcacatgcaggccgaatcttttttttctgaccatgtaaagaaagctctgacaaacgatcctcccggggaatggatgccggcagttccgaaagcgtgcatccccctgcattccggctatcccgatcccgcactcgttcctgataaggagctgaaagaagccgccgcccaccttctggatgaggagcgcgatctgccgctgcattatatgggaagcccgaggacggccgttttaaaaaagcagattcaagaacggttagccacccgcggcattcactgtcgggacgatgagctgctcgtgacgtcaggcgcctgtcaggcgatagatctggcagcccgggttttcctcgatgaacaaaccgccgctgccgttgaagctccggtttatatggaagcgctcgagatttttaaaaattacacaccgcatatcatgagcattccgacagatcaagagggcctgcaaacagaaacattagcgttcatgcttgaggaaagaaaacgaaaagggcttctgattccccgtcttctctacacgatacccgcttttcagaatcctgcgggaaccgtaatgtcagcgaagcggagaacccgcctgcttcagcttgccgaagcgtatgattttctcatcttggaggatgatgcatacggcgagctcggattcaccgatattccgccgcctttgaaagccatggatcaaaacggccgggtgctgtacgccggttcattatcaaaagtcatcgccccgggtatgaggatcggctggattgcaggggacgccgcattcatcacggcattgtcatggttaaaaaaagacttaggccacccgttttcccaagcggtgaccgccgtctatctggaacaaacgaatgtggaaaaacggctcgccgccttgcgggaagcatatcaaagcaaacgtgacgttttgctcgccgcaatagcgcgatatcttccggaatccgcatcctggcacgtgcctaaaggcggttactttgtatgggtgaaagcgcctggagcggatacgtccgcactgctggcgcaggctctttctcacggcgtttcctatgtccccggaaaatatttttttctgcatcaggaagacggtgcggaatatcttcgcctgtcgttcagttatgccggtaaagccgcgataaaagagggtgtgcaaaaactgggacgcctgctggaaaacgggatgtagagcagcatgaggagctttcgggcttctctttttttgtcccctcagcacatcaggcgaaaggatttttcagaaaaaccttccaatccatattcagaatagtgtaggatattcatagagctttcctaaaaacaggtcatcagatgaccggatcacatattgaggatgaaagaggggttcatcatgaaagtctcattatttgtcacgtgccttgtggatatgttccagaccaatgtcggaaaggcgacggttgaggtgctggaacggctcgggtgtgaggtggattttcccgaggggcagatttgctgcgggcagcccgcatacaacagcgggtatgtgacggatgcgaaaaaagcgatgaagcggatgattgccgcgtttgaagaagcggagtatgtcgtcagtccgtcaggttcctgtacgacgatgttccgtgaatatccgcatctgtttcaggacgatccgaagtgggccgcaaaagcgcagcagcttgcggacaaaacatatgagttaacggattttatcgtcaacgttctcggggtggaggatgtcggggcggtgctgcataaaaaagcgacagtccatacatcatgccacatgacgaggctgctcggcgtgtcggaggagccgatgaagcttttgcgccatgtcaaagggctcgagctgaccgcgcttcccggaaagcaccaatgctgcggattcggaggaacattttctgtgaaaatggcgcaaatctctgaacaaatggtggatgagaaggtcgcctgcgtggaagacacggaggccgaggtgctgatcggggcggattgcggatgtctgatgaatatcggcgggcgtcttgaccgtaaggataaaaacgtcagagtcatgcacatcgcagaagtgctgaacagcagataagacgagaaacaacaagggggtaaaatcatggcgatgaaaatcggtaccgccgcttttaaagagcgggtatcagaaggaatagataatgagtttatgagaggagccgtctccggtgcgcaggaacggctcaggacaagaaggcttcaggcggccgaggaattgggaaactgggaggattggcgttcccatgcggaagaaatcagacagcatgtgctggacaatcttgatttctatttggaacagctcgccgaaaacgtcgccaacagaggcggacacgtctttttcgccgaaacggcggaagaagcgtcctcctatatccgcgatgtcatccggcagaaaaacgccaaaaaaatcgtaaaatccaaatccatggtaacagaagaaatcaatatgaacgaagtgcttgaggaagagggctgtgaagtcacagaaacggatctcggcgaatacattctccagattgacgaccacgatccgccgtcacatatcgttgctcccgctcttcacaaaaacaaagagcagatccgtgacgtgtttaaagagagactcgaatacaaacagacggaaaaaccggaagagctcgtcatgcacgcgcgcagcgttctccggaaaaaatttctcgaagcggatgtcggcattacaggctgcaactttgcaatcgcggataccggatcggtcagtctcgtgacgaacgaaggaaacggccgccttgtgtccgcgctgccgaagacgcagatcaccgtgatgggaatggagcggatcgttccgtcattttctgagtttgaagtgcttgtcagcatgctgacgagaagcgcggtcggccagcggcttacaagttacattacggcgctgacgggacctcgtcagcaaggagaagctgacgggcctgaggaattccaccttgtggttgtggacaacgggcgttcccgcatactcggcacggaattccaatcggtgctgcaatgtatccgctgcgccgcctgcatcaacgtctgtcccgtgtaccggcatgtcggcggacactcgtacgggtccatctattcgggtccgatcggcgccgtcttatcgcctcttctcggcggatatgacgaatacaaggagctcccgtacgcatcttccttatgcgcggcctgtacggaagcatgtcccgttaaaattccgctgcacgagctgctgctcaagcatcggcagaacatcgtggaaaaagagggcaaagcgccgatcagcgaaaaactggcgatgaaagccttcgggctcggctcgtcatccccgtccctttataaaatgggatcgaaatgggcgcctgccgccatgacgccgtttacggaagatgacaaaatatcaaaagggccggggccgttaaaagaatggacggcaatacgggatttcccggcgccgcataaatcgagattcagagattggtttaaagaccgggaaaaacaaaagggggaagaatgatgatgaaagggacggttacacatcaggaatcctttttaaaccggatcgccgaaagtctgggcagagagcgcaggaaatcaggcgtgtccctgcctgaatggaagtatcagcctcaatatcaaacgcatgcggactgtacggaagacgatcttgtcacgatgctgaaagaccactgtgtcaacattcataccgaactgatcgaaacggatgcagccgggctttacgacgctttgcgcacgcaggtgaaccgctttgaaggagggcctgtcatcattccgaaggacagccggtttgaaacgtacggcttgcagacccttatgacagaagagtggccggatgaagggattccagtttgggaatgggacgcggaacaaggagcgaaaaatattgaaaaagcggaacaagcgaatgtgggcatcacattcagcgagattacgcttgcagaatcagccaccgtcgttttgtatgcgtcagagcatgccggccgttctgtcagcctgcttccgaccacctatatcgcaatcatcccgaaatcttccattgtgccgagaatgacacaggccagcgatatactgaaacagcagatcagagacggcgtcaccgttccttcctgcatcaactatattactggaccgagcaactcggccgatatcgaaatggatttggttgtcggcgtccacggacccgttaaagccgcttatatccttgtgaatgatcgataaaaaaacaaaccccggtttgcggccggggtttgtttttatataaacgcgttaatgatcatgataaaacagatcgcactgacagaaataatcgtttccatcgccgtccatgtcaggaacgtttcttttaccgtcattccgaaatactctttaatgagccagaaaccggagtcattgacatgtgacagaatcaaagagcccgctcccgttgccaaaacgagaagctcgctgctgacgccaggcatgacagatgcaatcggtgcaacaatgccggccgccgtcatcatggcgacagtcgctgaacctgtggcgacgcggatgaccgccgcgatcgtccagcttaaaagaacgggagagaagcttgaatgcttcgccatgtcagcgatatacgtgccgacgcctgaatcaatcaggacgttgttaaaagcgccgccggctccgatcacaagcagaatggaagcgatcggcccgagacagtcattgctgaattttaaaatgctttctctgtcaaagccctgataaaaaccaaggctgaaaaaggagtaaaccgtggcgatcaaaagcgccgtgacagggtcgccgataaatttaaaagtttcatagagcgcgcttttttccggaagcgcaatttcggcaagcgttgccataagcatcaggatcaccggtaccaatatcgtaaacaatgtatttgcgaatcccggaagcttgcgtttttcattccgttcaataaattgttttttcaacagttcgggaacgggtttatgaatgcgcttaccaatccattttccgtaaagcggccccgcgatgatggcagtcggaatgccgacgattaaagaaaacaaaatcgtttttccgacattggcgtgataaatgccgacagccgccatcgccgccgggtggggcggaaccaatccgtgcacgacggaaagtcccgcaaggagcggaatcccgatcgtcactaatgaaaccccggtttcaatcgcaatcgtaaataaaagcggcacgagcaggacgaagccgacctggaaaaagaccgggatgccgacgataaaagcgacggccatcatcgcccaatgcactttctttttgccgaagcggccgatcagggtgtgggcgatacgctccgcaccgcctgattcagccatcatttttccgagcatcgtaccgagggccagcacgatcgcaagcagcgacagcgtattgccgagcccggttttcatcgaagcgataatgtccggcagattcatgcccgttgcgaaaccgacaaggatggatgtaatcaaaagactgataaacggatttaatttagcgaccgtaatcaataagagtaaaacgataatagcggcaatgacaataaacagtaacatgaccttttcaccctttcaaagaagaattaacggctttgtttgagctgaaattcactgatgacgtcaaattcatctttgagcttgtcatacagccgctcgtataagtaaaacagctcaatatatgtttcgctgtttttgacgttcggttcatgacggtgagaaattctgatccagtcctgaacatcctcgatccgttccatttcgccaaggctgtgcaaagcgagaacggccgctccgagcgccgaggcttcgtaactttccggaacgaggacttcccgtcccatcgtatcggacaaaatctgcctccaaagcggtgatctcgcaaatcctcccgaagcccgcacgtcttttgcggggcccgccaaatctctcagtgcgacaccgattgaaaagacgctcatgatgacgccttccagcaccgctctgataaaatgctcccgtttatggcggaggctgatgccgaaaaacgttccgcgggcattcggattccaaaacggcgcgcgctcccctgataaaaacggcagaaacagcaatccctcagagcctgcgggcactttatcagcgatatcaatcattaaatcgtacggatcaatgccgagccgcttcgccgtttcgacttccggagaagcgaattcgtctcgaagccagcgcagcataatgcctccgttattcgtcgggcctccgatgacccaatgcttgtcagtcagcgcgtaacagaatgtccgcgctttttcatccgtaatcggcgcatccgtcaccgaacgcacggctccgctcgttccgatcgtaacggccacttcgcctttgccgatcgcgccgactccaaggttggcgagcacgccgtcatttgcgccgataataaacggtgtatccgcatgaatgcccatccgtgcagcgatttccggcgcaaggccgcgcagctgatgagtggtcggcacgatgtccgacagctgatcttcccggattccggcaatccggagcgcttcttcatcccaggaaagcgtatctaaacggaacagccccgttgccgaagcgatcgaataatcgacgacataagttccgaaaaactcgtgcagaatatattctttaatactgatgaatttggcggttttcgcgaatgtctccttgtcctgttctttcatccacacaattttggaaagcggagacatcgggtgaatcggcgtacccgttcttttataaatatcaaaaccgttcatctcttttaaaatccgttttgattgctcggcgctgcggttgtccgcccaaatgatgcttttggtcagcaggccgccgttttgatcgacagctatcaatgagtgcatggcggtgctgatgccgattgcaagcagattgtcaggactcagtccggcctttgtgacggctcccctgatgcttccgataaccgcttccaaaatgtgctcaggatcctgctcggcccatgccggctttggctgtattaaatcatagtgaaccgaatgcttggctaacactttgcctcttggtccgaacagaacggctttcgtactggttgtgccgatatccagaccgataacagcttgggtttccttcataatatatcccgcctaatctgattgaataataagatagattgataatgtatgcccttacaaagtcaattataggaataattttttataaatcaacgatgaagaagaaaatttttttcataaaattgcctcaattcccgctgtatcggcattctctcttttgaaaaataaatattcagaaagcgattacaaacgtttgtgcgcgatcatttttctgatttgctgcaagttggcgagcgttttctcctgccgcagccgggccgtggcgaaatacagtgtatcaatgaccgacagctgggcaagccttgcggacattgcttccgttctgaaagccgtctcccttgttgacgtatacagcaccacgtcggaaatctgggtgagcggcgacttttggtagcttgtaatgccgatcgtgccagcgccgagcgatttggccattttcaccgcgtcaagcacgtccttattgcttcccgaatgagaaatgccgatgactgcgctttcgggaccgagaagacccgctgacatcgcctgaaagtgagaatctgtgtgcgcgatgcaatttatacccgtacgcataaatttatgatacgcgtcagtggcgatcagcccggaaccgccgtttccgtaaaattcgattctgtctgcgcggtggatcatttctaccgctttttcaacgtcggccggatctaataaatgaaaggtatcggtcagaccggaaatgtttgtgcggaaaactttctggatgatgacttcgatatcgtcgtcggggctcatttcttcatgaatgtgctgcaccggctcctgaacgatctcctgagcaagcgcgatttttaaatcctgatagccggaaaaaccgagccgtttgcacagcctgaaaatcgtcgcttcagagcttttcgttttttccgccagctgaatgatggaaaggtgaaccacgtctttcggttccttcacgatatggtctgcaatcgctctcaattttggcgacaaacctttgctggccgcctgaatcttcccgatgctgcttgaattcacaggggtcatgctataacctccctacttgaatgtaaacgcatacttttatgataaagcaagtttcaatataaggaaaacagaattttaaaattgttttttcaattttgtatataaaaaaagagaaaaagccgccgatgatagaaagtgaggaggcacctgaatgaaaaaagtatggattctcgtcatatcattcggcattgcgcttgcgctgtttttatacgcaaacacaaaggtgaaagcggaaagcgcggcgcccggaaagcaaagccttgtgtccggatttcagctgaaatttccgaatcaccgggtaggacaataggcggcaaaaattagtattgactttgaaaatagaagactgtatattatgatactatattcagaaaataaaaactcaagagattcatttaacataaaacactgtgaacgggagcagtaaaagaatccagtcagaaaaagagagccgcgggttggtgcaacgcggactgattgttctttgaactcgcccggaagtggcagggcggaacggaattgtcggaatattccctatgtcctaacggctgaccttcgttaaaaggtttttaagctggattccggatatttcgggatcaacaagagtggtaccgcggctgcctaaggcacgccgtctcttttcctaaagaggcggcgtgcttttttatgtgatgaacactttttgcgagagggcgtgtgatagatggaaaaggacaagcaaacgttaaaacggacgatgtcgtccagacacattatgatgatggcgcttggaggcgcgatcggggccgggctctttaaaggcagcagcacggcgattgatgaggcggggccgtccgtgctgctggcctacctcctcggcggaatcattctgctatttattatgcaagggctggccgaaatggcagtcagaaacaaacatgcaaggacgttccgtgatttggttcagcagtcgctcggatcgtacgctgcatactttttagactggatctattggaaaatgtgggtgctcaatattgccgcggaggcggtcgtagccgccattttcattcaatattggctgccggaatgtccgatatggatactggctctgatcatttccatcgtggtgacggtcgtaaacatgctttctgtgaaactgtttgccgagacggagtactggctcgcgcttattaaaattacagtgattgtcatctttattttatgcgggattctgcttttatttttctcattcggcaatcacacggcgccggggctgtctcatttaacggatcacggaggatttttcccgcatggagcggggggcgtcattacggcgatgctcgtcgtgatctactcatacggcggaacggaaatcatcggcgtcacgctggcggagacaaaaaatcccgaaaaggtgatcccgaaagctgtccgaagcacgttaacgcggattgtcgctttttacttgctgccgtttttcatcatcgtcagcctgattccttggaatcaagtcaacagcgttcccgaaagcccgtttgtcatagtatttaagatgatcggaattccgggtgccgaccatattatgaatgccgtcattcttcttgcgattatctcgtctatgaattcgggactgtacggatcatcccgcgtcttgtttacgcaggcttctgacggccgggtgccgaaagttttttcaaaactatcgaagaaaaaggttcccgtctatgcgattctgacttgtacgtcatttttatatgtaggcgtcctgatttctttattcgcaggaagccagacgtttaattatttgatgggttcactcggctataccgtgctgttcatctggctgattatcggattcgcccatttgaaatcaagaaaacattcaacagaacagccggcttattacgtcaaatggttcccgtacacgacatggttctcggtgcttgcgcttttggccatcctgatcggcgtaattgcgacgacatccatcgtcatcacatgcatcactgcggccatctatctcctcattacggctgcgtatcttgtgaaagggagacgtcaataaataaaaaaactcttgccccgcggcaagagtttttttaatgaacggcctttttttctgcggccagagcaggtgttttcagtttcttcggtgttatattcactaaacaaatgcttgtgacgatcagaagcagtccggctaaaaggctgacggtcagcggctcatgcaggaatatcgagctgacgacaatggatatgagcgggatcaggaaggtgtaagaggcaaccttgcttgcttcccctgaaccgacaagcgtaaaaaaggcgagccagccgagcgcgataacaaaaactgaaatgaacagaaggctgagaatgaacggagctttccattgaatggctgaaaagctttctgaaaaatggccggagctgacaagcagcacgccgccgatcagaagctgaagagcgaccatccagatagaatccgcgcgtccgcccgttcttttcacatataccgtgccgagcgcccagctgaccgcggagcctagggccaaaagaatgccggcgatggaaatatggcctccgaaaccggctgcgctgatgacggcgacaccggcaaagcccagaataagaccggctatttttaaaggatacatcgattccccgagccacagccaagaaaaaacgcccattaacaccggctggaaaaacacgatggctgaaaataggccggcaggcaggtaattcaagccgaccgtttgcaggccgtaaaataaagtaatatttaaaatggcagaaataagatagatcggccacgtttctttaaaacgcagctttttaaaacggggcagcgccaccattaataatagaagtccgccgatcagcgtgcggattccggcaaacagaagaggcggcgaataggcaagcgcggcctttgtcagcggccagttaattccccataccgtgactagaaacgccagcataagagccgtctgtattttcgaaagctgtttcacgtcgttcactccttgtagaacaattccatcatatgatacggtaatcagtaagataaataaaatgaatcttttttataaggagcataagtaaaacgttatgacgattacacaactgcgggtttttgttcaaatcgctgaaacgggaagctttacaaaagcggggcaggcgctgaatatgacgcagcccgccgtcagccatgccatctcggcgcttgagtcagagctcggcatcaagctgatcatccgcgagcgccgcaacggcgtaaggctcacggacacgggcggaaaaattctcgttcatatcagagaggtgctcaaaggcatagaaaaagccgagcagctggcggccgcggaaagagggcttgaacagggaacgattcacatcggcacatttccggccgcttccgcttatttcattccaaagctgatcagcgtgtttaaaaaacggtatccgaagcttgaactggtgcttcatgaaggaacggcggacgaagtaaaagaatggctgcaatcccggatgattgacgcgggcattctgctgttcccgacagaggatatggattcctttctgctgaaaaaagacaaaatggcagcggttatgcataaagatcatcctctcgccgcacgctcaaccgtaacgataaaagatctggacggtgaaccgatggtggtttgcgaaggcggttacacgtcaccttttgcaggcctgtttaaacaagccggtgccgaactttgcgcggcctttaccgtgtttaatgtcagcacgtccatcaatatggtgcgggaggggttgggcatggcaatcttatccgatatgtccatggccggcaatcccctcccggaagaagtggtgattaaagagtttacgccggatgtattcagggaggtgcagctggcggttccttccatgaaagacgcatcacttgccgccaagctttttattgatgtcgccgaggagctgttcatccgtaagaaaaccgccgctgactgattgttcgaagatcatcgaatcaaattgtttaactcacgggaaaagctgtggtaaggtgtgtagagagaccttgtttaagatctgcttacactaaaccataaaggagaaaacgatggctgaacatacattgaaagatactgcgttttccgtattgaatttatcgccggtcgtacaggggggaacggttgctgaatcgttccgcaacagcatggatttagcgcgccgcgccgaggagtggggctataaccgctattggcttgcggagcatcataatatagaaggcgttgccagctcggcaacggcggtgctgatcggccacatcgccggcggcacgaaaaaaatccgcgtcggttctgggggtattatgctgccgaatcattcgtcacttataatcgcggagcaattcggaacccttgaaacgttatatccagggcggattgacctcggactcgggcgtgcgccgggtaccgaccaattaacggcgagggccttaagaagaaacataaacagcggggaggatttcccggagcagcttgaagaattgagaaattacttcaaaccgtcaggcaatgtgcgcaatctagtccgcgccattccgggcgaagggctggacgtgccgatctggcttctgggctcaagcggcttcagcgcgcgtcttgcgggagagctcgggcttccgttcgcctttgcggctcacttttcaccgaaaaacaccgtgcccgcccttgagctgtaccgcagctccttccgtccgtcagatgtactggataaaccgtacgcgatggtcggcgtcaccgtcattgccgccgatacggatgaaaaggcggagcatctggcaacatcgcattatcaaagatttttagacctcgtccgcggcacgccgaaccagctgaagcctcctgttgaagacatggatcaaatctggtcgccgtatgaaaaagcgatggtcaatgaacagctcagttcaacgatcgtcggcggaccggagcgtgtgaaggagaagctggaaagcttcatccggacaacacaggcggatgaaatcatggtgaattcagaaagctttgagcatgccgacagaatgagatcatttgaaatcatcgccgaattaaaaagatgaaaaacgggcagcacactatatatatatgtgctgcctgttttcgtataataatatgaaatttcatattattgtgatattatttattagaaaaattttcttgaaatagaaggggggaataaaaacttggatgtttctttgaaagatgtttttggtatttcgcggattgttttaaaaagttatgttgatagacaacaaattgatgaggattaccaagataaaattgaacttacggatcatcacatcgtaatatatggtgaaacaaaagtcggaaaaacattattaagaaaaaaatatgtaaccaaagctgaaaacactatagtgatagactgtacgaagggagttgatttagctgatatttacacacaaattttatacaaatctggtgtggagatatctgataacttctccaaaagtattgaaaagtgctcaaaaattgatagtcaagtagaggcaaatctatttcaatttttaaaagcgaaagtgaccggagattcatctgaaaaagagttattaagtgaatcagggaaaatggatcttcccaagaccgtaagtgtcagagtggctgaatcactgaaggaaaaaggtattcagtttatcgtactggatgactttcattatttaaatttagtcgatcaatatctgttggcttttgacctgaaaatgttttatcaaagcggcttaaggttcattataatcgggacgaaaattataaatggctattttgaaaaattcaatggagaattatctcaaagaattgattatattgatgctactaaatggtctactacagatttaatgaatataaagagtagaggctgtaaagagctgaacatagacattagtgaaaatgtaacaaattattttatagaggcatctagccaaatagttgctgtatatcaacaacttctttttgactattgtcgtgaaagtgggataagaaagagaagtcagaattacattgttcttgacagtcttgaattagctaaggaatgtaatgctctgtattataaaagagtaagcgaggaatatctgacaaaaattcaagacattgcagatggagaaagaaaagcgaagctgaagttatactattatataatgaaaattgtgttaacgtctgatcaagatatagcgaggagaggattttcttttcagtatttatatgagaatattcaccgaatccatgagaaaaagtcaataaatcatggtgcgctgacctctgtacttaaccacttcgatgaattgcaatccaaaaaggatatctttccaaaggtctttacatactatgataaaagactatatatttcagattcgtcattttattatattttaaagcattttaataaagaaaatatagatgatgttcttccgcctcatgattttcagcttagttttcaatttaatgactgatgggcagatactgttgtatctgcccttttttattcgccgatccgcctgactgaattccggatgatgagttccggttcatacacgacgtcatccttcttcggttttttatgttctaagcagtcgatgacgtattttgccgccgctttccccataatggatttcggatgcttgacagaggtgagcttcacctcggaaatctgggcgaaatgtgaatcatcatagcccatgaccgatacgtcatcaggcacctttaacccgaattccctgagaagattaatcgtcttcagcgcaatttcgtcattgtagcaaagaatggccgtcggatgtgacccgctgttttgctcaagggtatgcttaattttttggagaagcacggtttctttttcctcagtcgtgtaagtcacgatcatgtccggagacggaaaaatcccgcgctcccgatgtgcctgaagatagccgttcatccgtttgacgccctgcgtgtcatccgctttaaagattcccataatgtgcgtgtggccgagggacatgacgtattcgcaagccatcatgccgcctttgacatcattgacggaaaagcttggtgcggccagctccgcataagaggcgttaatcatggcaaacggaatgccgtttttctccagattgagatagtagccgatgttgggcgtctgcagcgcgctttttgtaggctcgacaatcagcccgtctatatttttggacagcaggttttcaaggccgcgccgttcactttctgtattgttgttggtgctcgtcagcagcatggaatagccctgttcgcttaaatacgattcgattcccctgatgatgctcggaaaaatatagtctgatatgtacgttgtaatgacgccgatcgttttgtttgaatgcatggctgatttcgccgtgcgtgaagcgacaaaggtgcctccgccctgaacgctgtacagcagcccctgcgagaccaaatctccgatcgcctttctgatggtatggcggctgacgccgaactgctgcatcagctcattttccgtaggcagcttttcgtccggctgtatttttccttgattcagccatgaacaaatttcttcttttacttgagcatatttcggtagcatatcaattcctccaaaatgtatacggacaaattccagtataacatagtaagccctttcatcaagctgtaaaaataattgacagattatgaaaaactgcttattctttatttgtacgtactaattttccttatttttagataaaattctttataagtacgtacaaatgtggcgattctgaagaaaacaaagcaacatcaagcgccgcactcagatttgtaagcgtttttattctattattcgcgggagggtaaaattcatgaagaatcacccggcaccaattggctcaaatgtacctgtcactcggcagcattccaagtggtttgtcattctcatctcatgcgcggccggactgggagggcttttgtacggttatgacacggcggtgatttccggcgccatcggtttcctgaaagatttgtaccgcttaagtccttttatggaagggctcgtgatttcaagcataatgatcggcggtgttttcggcgtcgggatttccggatttttgagcgaccgtttcggacggagaaagattttgatggcagcggcgctgttgtttgcggtgtcagcggttgtctctgcgctttctcaaagtgtgtcttccttagtgatcgccagagtcatcggcggtctgggaatcggcatgggctcctcgctttctgtcacgtatattaccgaagccgctccgccggcaatacgcggcagtctgtcttcactgtatcagctgtttacgatattagggatttccggcacttattttattaacctcgccgttcagcagtccggctcatatgaatggggggtgcacaccggctggcggtggatgctcgcttacggcatgattccgtccgtcatcttttttatcgtgctgcttatcgtgcctgaaagcccgcgctggcttgcgaaagcggggcgccggaatgaagccctcgccgtgctgacgcgcattaacggcgagcaaaccgcgaaagaagaaatcaaacaaatcgaaacgtctttacaattagaaaaaatggggtcattgtctcagctgtttaaaccggggctgagaaaagcgcttgtgatcgggattctgctggctttattcaatcaggtcatcggcatgaacgcaattacgtattacgggccggaaattttcaaaatgatgggcttcggacagaatgcggggtttatcacgacatgcatcgtcggtgtcgttgaagtgattttcaccattatcgcggttcttttagtcgataaggtgggccggaaaaagctgatgggggtcggatctgcctttatggcgctgttcatgatcttaatcggggcatccttttattttaagctggcgagcggtccggctttagtcgtcattatattgggattcgtcgccgctttctgcgtatcagtcgggccgattacgtggatcatgatttcggaaatctttccgaaccacctccgcgcacgcgccgccggtattgcgacgatattcttatggggggccaactgggcgatcggccagttcgtgccgatgatgatcagcgggttggggctcgcgtacaccttctggatattcgccgtcattaatattctctgtttcttgtttgtcgtgacgatctgccctgagacgaaaaataaatcattagaagaaatagaaaaactctggataaaatgaaagcgttttacgacaaaagtccgctccggcgggcttttgtctgtcaccttcattccgtttctgtatataatgactgtatcaaggagatactgggaaatcctgcgaagaatgtcgacgaattgacctttaacagttgaattaacaatgtcatcctgttaaaataattaaagaaagcagacataattttttttggctatgatgggacgttttttgtcatagcgggacattttctgtccagtatgaataggaaggaacgtttgagtcatgaaccagttaatacaagctcaaaaaaaattattgcctgatcttttgcttgtgatgcagaaaagatttgaaatcttgcagtatatcaggcttaccgaaccgatcggccgcagaagtcttgcagccagtctcggattgaccgagcgcgttctcagaagcgaggttcagtttttgaaagaacagaatctcatcgatattaaaacaaacggcatgacaatgacggaagagggctactcactgctttcgattctggaagatacgatgaaggatgttttaggattgacgcttttggaaaagacattaaaagagcggcttaatctgaaagacgccattatcgtttccggagacagcgaccaatctccttgggtcaaaaaagaattagggagagcggccgttgcatgtatgaaaaagagattttcaggcaaaaatatcgtcgctgtaaccggcggtacgacaattgaagccgtcgccgatatgatgacgccggattcaaaaaaccgcgagctcctgtttgtgcccgcaagaggcggtttaggcgaagatgtgaaaaaccaggcgaacaccatatgcgcgcatatggcggaaaaggcttcaggcacttaccggcttttgttcgttcccgggcagctgtcacaaggcgcctactcatctattattgaagagccttccgtaaaagaggtgcttcacacgattaaatcagcgagtatgctcgttcacggaatcggcgaagctagaacaatggcggagcgaagaaacacgcctttggaagatttgaagaaaatagatgacaatcatgcggtgacagaggcattcggctactactttaatgcggacggagaagtcgttcacaaggtgcattcagtcggaatgcagcttgatgacctcgatgccattcccgacattatcgcggtagcgggcggatcatcaaaagcagaagcaatcgaagcttattttaaaaagcagcgaaacacggttctcgtcacggacgaaggagccgcaaagaagttattaagggataacagtccctcaatataaatatctctcacttatttaaaggaggaaataatcatggcagtaaaagtcggtattaacggttttggtcgtattggacgtaacgtattccgcgcagcattaaacaatcctgaagttgaggtagtagcggttaacgatttaacagacgctaacatgcttgctcatcttttacaatatgattccgtacacggaaaattagatgcagaagttaaagttgacggcagcaaccttgttgttaacggcaaaacaatcgaagtttctgctgagcgcgatcctgcgaaactcagctggggcaaacaaggcgttgaaatcgtagttgaatctactggtttcttcacaaaacgcgcagacgctgcgaaacacttagaagcaggcgcgaaaaaagttatcatctctgcacctgctaacgaagaagatatcacaatcgttatgggtgttaacgaagacaaatacgatgcggctaaccaccatgttatctctaacgcatcttgcacaacaaactgccttgcgccgtttgcaaaagtacttaacgacaaattcggcatcaaacgcggtatgatgacaactgttcactcttacacaaacgatcagcaaattcttgatcttccgcacaaagactaccgtcgtgcgcgtgcagcagctgaaaacatcattcctacatcaactggtgctgctaaagcagtttcccttgttcttcctgaactgaaaggcaaactgaacggcggagctatgcgtgtgccgactccaaacgtttctcttgttgacctagttgctgaactgaacaaagacgtaacggctgaagacgtaaacgcagctcttaaagaagcggctgaaggcgatcttaaaggaattctcggctacagcgaagagccattagtatccggagattacaacggcaatgctaactcttctacaatcgatgctctttctacaatggttatggaaggcagcatggtaaaagtaatctcttggtacgataacgaaagcggctactctaaccgcgttgttgaccttgcagcttacatcgcaaaacaaggtctttaattcatagctcccggaaagggccggacttggttctttcggacagaaacgctataatgaaagcggacaagggaaggggacggactccctttccctttttccatgagaaccggctttcagaaagcgccggattgctgcagaacgtccgcgttttgaagtttccgcggcactttcgttttctgagccgcctgccctggctcagaagacgatctgccccgtgcccggaagctgcaatctgccccgcggcggaagcatcatgaggcggtttcacgtttcacgtttttcgtgctatgcaaaccattttgaaggaggatctcctaaggcatgaataaaaaaacagtaaaagacatcgacgtaaaaggcaaagtcgtattctgccgcgttgactttaacgttccaatgaaagacggggaagtaacagacgatactcgtatccgagctgcgcttccaacaatcaaacaccttgcagaccaaggcgcgaaagtccttcttgcgagccacttaggccgcccgaaaggcgaaacggttgaggagcttcgtttaactcctgtcgctgcacgcttaggcgaactgctcggcaaagaagtgaaaaaagcggatgaagcttacggcgatgctgtaaaagcacaaatttctgatatgaaggacggagacgttcttgtattggaaaacgtacgtttctaccctggtgaagagaaaaacgatcctgagcttgctaaagcatttgctgagcttgcggatgtatatgtcaatgacgcattcggtgctgcccaccgtgctcacgcatctacagccggaattgccgagcatctgccggcggttgcaggattcctgatggaaaaagagcttgacgttctcggcaaagccgtgacaaatcctgagcgcccgtttacggcaatcatcggcggcgcgaaagtaaaagacaaaatcggcgtaatcgaaagtctgcttgataaagtggacaacctgatcatcggcggaggtcttgcttacacattcgtaaaagcgcttggctatgaagtcggtaaatctttgcttgaagaagataaaatcgaacttgcaaaatcattcatggaccgcgcgaaagaaaaaggcgttacattctatatgccggaagacgtgctcgttgctgatgatttctctaacgatgcaaacgttcaaatcgtgccgatctctgagattccaagtgatttagaagcgatcgacatcggaacgaaaacccgcgaaacgtatgctgaagttatcaaaaacagcaaacttgtcgtatggaacggaccgatgggcgtattcgaaatcgacttgttcgctcaaggcacaaaagcagtggctgaagcattggcagaggcaaacgatacatactctgtcatcggcggaggagactctgcggcagccgttgaaaaattcggccttgctgacaaaatgagccatatctcaacaggcggcggcgcatcccttgaattcatggaaggcaaagagcttccgggtgtagctgcgctgaacgataaataaaaactgctataaggaagtggaacagatgagaaaaccaattatagccggtaactggaaaatgaacaaaacactcggcgaagctgtcagcttcgttgaagaagtgaaatcttccattccagcagcagacaaagcggaagccgttgtttgcgcaccagctcttttcttagaaaagctgacttctgctgttaaaggaactgacctgaaagtcggcgcccaaaacatgcattttgaagaaaacggtgcgttcacaggtgaaatcagcccggtcgctctgaaagaccttggcgtggattactgcgtcatcggccactctgagcgccgtgaaatgttcgctgaaactgatgaaacagttaacaaaaaagcgcatgccgctttcaaacacggcattgtgccgatcatttgcgtaggtgaaacgcttgaagagcgcgaagccggaaaaacaaatggtcttgttgccgatcaagtgaaaaaaggtcttgcgggtctttctgaagagcaagttgccgcttccgttattgcgtatgagccaatctgggcaatcggaacaggcaaatcttctacagcgaaagatgctaacgacgtctgcgcgcatatccgtaaagtcgttgctgaaagcttcagccaggaaactgctgacaagctccgcattcaatacggcggcagcgtaaaacctgcaaatattaaagaatatatggcagagtccgatattgacggtgctttggtcggcggcgcaagccttgaaccgcagtcattcgttcaattattggaggaaggtcaatatgagtaaaaaaccagctgcactcatcattcttgatgggttcggattacgcaatgaaacagtcggaaacgcagtcgcacaagcgaaaaaaccgaatttcgaccgttattggaaccaataccctcatcagacgctgacggcatcaggcgaagcagtcggactgcctgaaggacagatggggaactctgaagtcggtcatttgaatatcggcgcaggacgtattgtgtaccaaagcttaacacgcgtgaacgttgccatccgcgaaggcgaattcgaacgcaatcaaacgttccttgacgccatcaaaaacgcgaaagacaacgacaaagcgctgcacctgttcggccttctttctgacggaggcgtacacagtcatatcaatcatttattcgcgctgctgaagcttgcgaaaagtgaaggactgacgaaggtgtatattcacggtttcctcgacggccgcgatgtaggtccgcaaacagcgaaaacttacattcagcagctgaatgagcagatcgaagaaatcggtgtcggcgaaatcgccagcatttccggacgctactactccatggaccgcgacaaacgctgggaccgtgtggaaaaagcgtaccgcgcaatggcttacggcgaaggcccgtcttaccgcagcgcgatggatgtagtcgatgattcttatgcgaacggcattcatgatgaattcgtcattccgtccgtcatcacaaaagaaaacggtgaacccgttgcgaaaattcatgacggcgattctgtgattttctataatttcagaccggaccgcgctatccagatttcaaacacgtttaccaacaaagatttccgcgatttcgaccgcggtgaaaatcatccgaaaaacctgtatttcgtctgcctgactcacttcagtgaatctgttgacggatatgtggcttttaaaccggtaaaccttgacaatacggtgggtgaagtattagcacagcacgggttaaaacagcttcgcattgcagaaactgaaaagtatccgcacgttacgttctttatgagcggcggccgcgaagaagaattcccgggcgaagagcgcatcctcattaactcgccgaaggtcgcgacatatgacctgaagcctgaaatgagcgcgtatgaagtgaaggatgctcttgtaaaagaaatcgcggctgacaagcacgacgcgatcatcctgaactttgcaaaccctgacatggtcggccactccggaatggtcgaaccgacgattaaagcaattgaagcagtggacgaatgcttaggcgaagtggttgacgccatcatcgctaaaggcggacatgccatcattaccgctgatcacggtaatgcggacattctgattacagaaacaggcgaaccgcacactgcccatacgacaaacccagtccctgtcattgtgacgaaagaaggcgtgacgctgcgcgaaggcggaatcctaggcgacctcgcaccaacgttattagaccttctcggtgttgaaaaaccgaaagaaatgacaggaacatctttaattcaaaaataagcgtaaatcaaaaggagagacaaactcatgccatacattgttgatgtttatgcacgcgaagtcctcgactcccgcggcaacccaacagttgaagttgaagtatatacagaaacaggagctttcggccgcgcattagtgccaagcggagcttctacaggtgaatacgaagcggttgagcttcgtgacggcgacaaagaccgttaccttggaaaaggcgtgttaactgctgttaacaacgtaaacgaaatcatttctccagagcttctcggctttgacgtaactgaacaaaacgcaatcgatcagcttttaatcgagcttgacggaactgaaaacaaaggcaaactcggtgcgaacgcaatccttggcgtatctatggcttgtgcgcgcgcagctgctgatttcttacagattcctctttaccaataccttggaggattcaactcaaaaacgcttcctgtaccgatgatgaacatcgtaaacggcggagagcatgctgacaacaatgtagacattcaagaattcatgattatgcctgtaggcgcgcctaacttccgtgaagcgcttcgcatgggcgctcaaatcttccacagcctgaaatccgttctttctgctaaaggaatgaacacagctgtaggtgacgaaggcggattcgctccgaaccttggttctaatgaagaagcgcttcaaacaatcgttgaagcaatcgaaaaagccggcttcaaacctggcgaagaagtgaaacttgctatggatgctgcatcttctgagttctacaacaaagaagacggcaaataccatctgtctggcgaaggcgttgtgaaaacatctgctgaaatggttgactggtacgaagaaatggtttctaaatacccaatcatctctatcgaagacggacttgacgagaacgactgggaaggccacaaacttcttacagagcgtcttggcaaaaaagttcagcttgtcggtgacgaccttttcgttacaaacacgaaaaagcttgctgaaggtatcaaaaacggcgtaggcaactctatcctgatcaaagtaaaccaaatcggtacattgactgaaacattcgatgcgatcgaaatggcgaaacgcgcgggctacactgccgttatctctcaccgttcaggtgaaactgaagacagcacaatcgctgacatcgctgtggcaactaatgcaggacaaatcaaaacaggtgctccgtcccgtacggaccgtgttgcgaaatacaaccagcttcttcgcatcgaagatcagttggctgaaactgctcaataccacggtatcaactctttctataacttgaataagtaatcgaaaaaacctccccatggggaggtttttttatatatctgcataaagccttaccatatcccggcactgtatcccgttttcgaaaatctcctcttcataatgcctgatgaaaaaatcatggtcgatggcttgaagtctgaagccgcatttttggtaaagggcaagctggcctatactggagttgcccgttccaatttcaatagtcgccgctcccatttgttttgccttattcacggcctcttctatgagctttctgccgatgccattgttctgcattgattctttcaccgcaatattgacgatttctactgtttttggtcttgttttcaaaaggacgaagacccctgcaagctcgtctgacgtccaagccgtatagcattctcctcttacaagataatcatcgacaatctctttcgacggatcggccagcagcaatagttcatacagcgcttcatccggctccgcggcttttcggatactcagtttttgcatgtccgtttctcctcctccattatgatcgacagctatttttcaaaataactccaaaatcattctactttattataaaatatgaaacataggaaaagttatacaagttttgcagattgaataggaggaaagtcatgtctttttgtaagtattgcggccagcagaacaacgaagaggcgcatttctgtaaagaatgcggaaaaccgatcgggaaaggaagccggctggagcggcaggcggctgaatccgcatcacagccgagaaagccgatccctaaaaaaacgctcttcctatggggaggcattgccgcagcgctgatcttattgattgccgcatataaaaccggagcctggctgacatctgaaaaaaggctcacagatcaattcgaacaggcggttcatgacggggacacgaaaaagctcgcagccctgctcactccttcagacaaaaaactgaagctgaatgagaccaatgtcaaaccgctccttgcatacgcaaagaaacacgatgaactgctggcatcgcttcgcggcaattcatcagaaaaagatgcggtatacgtcaaaaaagagggaaaaacccttcttttgtttgaccattacgaactgaaagtcgatccggtttatttccgcgtcacaagcaattataaaggcgccgatctttatatcaacagcgagaaaacaggtacggtcaaaaaagccgatgaaacccaaatcttcggcccgtatgcacccggtgtctacacggcggaagccaagcttaaaaatgagacggttgacgttgtcaaaaagcaagaggcagaggcggccggcagccggaatgttgagtttgacctgccgttagacgccgaggatgtgacattcactccggcagacagcttcaaaagcgcgaaaggcgatctgctgataaacggcaagtccgtccataaagatccgtttacatccgttacatacggtccgctcttaactgacggttccatgacagccgccgtggaggctgattttccttgggggaaaatgaaaactgccgatgttccgatcaacagtactgatgtggacttaacgcttatcccggatcaagatacacaacaaacaatcatggacacgattgtcaaaacaacgaagcagtatacaaaagcgatggcagacggaaataccgatcagatgaccgaggctggttccgcctggaaagagcagacgaaagaagtggtatccggcatgaagagttccggcacctttttgaaggatcagtataaagagacaagctttgatctggattcatttgcgatttctcaagagaacggccgctggcaagtaactgttacgggtaaagagcttcatgagtctgcttatttcgacgggaatacgaagcctgatatggaagaggctgagccgagctttcattatgtactctcatatgatacaaaacataaaaaatgggttttcgaaaaagctgaccctgcctcagattcttccgggacaaatgtaaaaaaaataaaaaatgaccagccgaaaacctatacatccgcatgggcatcatccaaaggaaacacagcttcagccagcgtgacaaacgagcaagtcacatcgtttatgactgattacctgacaaatcaatcaagcgccgtcagccttaacaattttgccatcatggcgggcaatttagaagaggggagccctttgtatgctgatcagcagaaactggtcaaaaaactgcacagcgaggggacgaccgaagtatttaatgaagtgaatgtcaaaagcttttcacagaaaggctcccatttgacgattcacacgtacgaggagttttatattacgaaagccggcggcagtccgaagctcagaacatacaattggacgtatggcggcgttgttaaagacggaagaatttatttaacatccattcaataaaaaaaacccccgcgccaatcaggcggcgggggtttccgtttttaaaagaagaaataattcatgagttcttttatataatgcttgatcgtgaattgaaacgttacgcaaatgatcaaatagatgacgataacagaataaatgatatccgccttagtagtgagctgatgctgatagctcgccagcatgagcggaggcacggcaaacgccgctcctaaaagaccgacagccagaatggtgaagcaaacggttgtatgaagcagcataaaaatgagggcaagaagcaaaatagctgtaaacggaatcaaaaaggccccgaatctggacagcgaatctttaaatgacacctgcgcgccgccggccttcaaagcgataaaaatcaagagatacaggcagaaaacgcataatgcaaaggtaagcgccggtttgatcacaaccgcggtaaaactgacgtcacgaaagccgtctgataggagaatataaaacataatcggcgtcaccaggcagaaaagcaccatgttgatgatgctgctgacaagctgttcgccgcctgtcgttttacatgtttggtacggtctctttaacacatcaagcacgaataaggcaaattgctttgaagcctgcttagccgcggcgccggcctgagcggcctggccttgcgtttggcctgcgcctccctgcccgggctggggcgccccgcacttttcacaaaactttccgccatcagtatgatggccgcattgagaacaatacattctaaaactccttttacaagtaatatagggattttgttcaatatttacattataaaagaaaatagggcggatgtaacggagttttctaaagatatacaaatcactttctctatgaattgataatagagaaaacgtacccattatggtagaattttaatggagctgatagatatcatgtctctcggcgcattgattcagagtgaaaaaggaaattaacgcatgctaaaaaaattgaaaatgctttatcggctgttgaaattcggaaaaggcttatggagatagcaaacaaaaaaaaccgtccttacaaggacggtttttttctgtttccggaccgtccggctgaggttataaaaagcagaccccggggtaaaaaccatgcataagaaacagcggagaacaaaacataactcaataacggcaagccataaggaggtacgcatgttttcattcatcattcatgtcttcatttcactgtttgcagtctccaatcccatcggaaacgtgccgatttttctttcactgacggaagggtactcggagaaagaacggacagcgattgcgcgcaaggcttccgtgctgtcgtttatcatcttggcggcttttttaatcttcggccatctgatctttaaactgtttgacattaacattcatgccttacgtatcgcgggcggcatttttattttcggcatcgcttataatcttctgaacgcgaagaaatctcatgtacagtctctccatcatgaagagaaaggggagagcaaggagaaagccgatatatccgtgacgcctttgtcgattccgattatcgccggtcccggtacgatcgcgacggtgatgagtctatcggccggccatggcggcatcatccattacatcagcgtgcttatcggcattgcggccgtcatcgcgatgacgtttatcttctttcactattcatctttcatcagcaataagctcgggaaaaccgaaatgaacgtcattacccgactgatggggctgattttggcggtggtggcgatcggcatgatcggcgccggtctgaaaggcatgttcccgatattggtttcctgacttaaaaaagcagcgcccggttatcttcgggtgctgcttttttctattttcggcacatgctgaaacacttcttcactctcaaaaaattctatcaaacggctcagccagtcataataatggagccaatccgtcagttcatccaaaagctggcgggctttttcttcaatatcgggactgagattttccgattccagaagctcagtcagctcacggttcagctttttatagagcattttgtttttgctgaccgcctttgtccaatttgccgtaaacagggagataaacgtctggtaataatcacgctcgacgtcgtaaaggtctttccgaacgcctttttcaaacactttttcagccagattggcatcggtcatttcgcggaccacctggctcatcctcgttttgctcatcccggtcgcctctgacagctcatttaacgtcatcggcttgcggttcatataaataataccgagcacacgtccaagtgtggccggcattccgaatgtatgcatattctcggcgattctctcaatgagatgctcttcagcatgcccgatgatatcaagagcgtttttttccacggctgatcatcccttcactggcttttcatgctgacaatatatcatattttttacagttgatgaaaaagatgatgcggcaggatatgcgagctatcgggagcgattgtaagaacatccgcattgtcagcgggataacatgaaaaaatacgtatattgtatataatttcaacacattgtaaactttttattttacaaatttcatcttataataaagattatacttttcagaaaaataacggaacccttcggaggtgcacggattgctgagattagaaaatgtatcgaaagtctataaaggcggaaaaaaagctgtcaacagcattgatttaaatatcgaaaaaggcgagtttatttgttttatcgggccgagcggctgcggaaaaacgacgacgatgaaaatgattaacagactgattgagccgtcatccggtaagatttttatcgatggcgaaaacattatggagcaggacccggtggagctgagacggaaaatcggctacgtcattcagcagatcggacttttccctcatatgaccattcagcagaacatttccctcgtgccgaaactgctgaaatggccggaacaaaagcggaaggaacgggcacgggagcttttgaagctcgtcgatatgggcccggaatatttagaccgctatcctcacgagctgagcggcggacagcagcagagaatcggcgtgctgcgcgcccttgcagcggaaccgcctcttattcttatggatgaaccgttcggagcgcttgatccgattacgcgggattcccttcaagaagaattcaaaaaactgcaaagaacattgaataaaacgattgtgtttgtaacacacgatatggatgaagccattaagctggctgaccggatcgtcattttaaaagcgggagagatcgttcaggccggcactcctgatgacattctccggaatccggctaatgagtttgtcgaagaatttatcggcaaagaacggttattgcaatcaagaccggatatagaacgcgtcgagcagatgatgaacaaaaagcctgtcaccgttacggcggacaaaacgctttcgcaggcgatacaggtgatgcgggaacaccgtgtcgattccctgcttgtcgttgatgacctgaatgtgctgcaaggatatgtggatgtcgaaatcattgatcagaaccggaaaaaagcgagtctcgtcggcgacgtgctccgctctgatctgtatacggtcgagcaggggacactgctgcgcgataccgtacgcaaaattttaaagcgcggaatgaaatatgtacccgtcgttgatgaacaaaggcatttagtcggaattgtcacgagagcgagccttgtcgacatcgtttacgattcaatctggggcgaggaagaccagctggtgacaggctgacaaggggaggaacgcttacaatgaatgaaatgatcaagtttttgcagacgaacggcggagaactgttatataaaacgtgggagcatttatacatttcgatcatcgccgtcatattaggcattgtcgtcgccgttccgctcggagtggcgctgacgagaatgaaaaagggcgcaggcgccgtcatcggtgccgtcaacattgtgcagaccttgccgagtctcgcgatactggcgttttttatcccgctgttaggcgtgggaaaggtgcccgcgatcgtcgcgctgtttttctattcggtgctgccgattctccggaacacgtataccggcattcaaggcgtaaataaaaatctgctggaatcgggaaaaggcatcgggatgacggtctgggagcagatcaggcttgtggaactgccgcttgcggttccggtgatcatggcgggcatccgcacatccaccatttatctgatcggctgggcgacgcttgcttcctttatcgggggcggcgggctcggagactatatttttatcggcctgaatctctatcagcctgaatatattatcggcggcgccgtgcccgtcaccattttagccattatcattgattatctgctggcggcgacggaacggaaggtgacgccgaaagggctgaaaggactgaaggaagtatcataaggagttggctgttttgaaaaaaaaccaaaagagatggatgtgcgcactggcgctgtcggctgctctgcttctaggcggctgttcccttcccggcctgagcggggcttccgatgatacgatcaaaatcggggcgcaaagcatgacggaatcagaaattatcgccaatatgatcgcacagatgattgaacacaatacagacttgaatacggcattaattaaaaacctcggatcgaactatgtccagcagcaggcgatgctcggcggtgaaatcgatatcgccgcgacgcgctactcgggaacggatttaacgagcaccctcggcatggaagcggaaaaagacccgaaaaaagcattagccatcgtccagaaggaatttgagaaacgcttccattacaaatggtttgattcttacggatttgagaacacatacgcttttaccgtcacgaaagagcttgcggaaaaagaccatttagacaaagtgtccgacattaagaagcatgccgatcaatttaagctcggtgtagacaatgcgtggctgaaaagaaaaggtgacggctataaaggctttaccgacacgtacggctttgaattcggcacaacctatccgatgcagatcggacttgtatacgatgccgtgaaaaacgggaaaatggacgccgtcctcgcttattcaacggacggacggattaaagcgtacgatctgaaaattttaaaagacgacaagcagtttttcccgccgtatgactgttcgccggtcattcccgacagcgtgctgaagcagcatcctgaactgaagggcattgtgaataaactgatcggcaaaatcgatacggaaacgatgcaggaattgaattacgaggtggacggcaagctgaaagaaccgtccgtcgtcgctaaagaatttctggagaaacatcattattttgaataagaaatgaggtggggcaaatggaagtgctgcagcagctcggcacttattattctcaaaacggcgtctatgtgcttcaggagttttaccgccattttctcatgtcggtatacggcgttttatttgcggcgatcgttgggattccgctcggcatcttcattgccagatacagaacattaagcggctggatattcgcggtgacaaacgtgattcagaccgtgccggcgcttgcgatgcttgcggtgctgatgctcgtcatggggctcggcgccaatacggtgattttgtcgctgtttttatattcgcttcttccgatcatccggaatacgtacaccggaatcgccagcattgaacatgcttatcttgaatcgggaaaagcgatgggcatgaccaaatttcaggtgctccgcatggtggagctgccgcttgcgctttccgtcatcatggcggggctgcggacggcccttgtcatcgcgatcggcattacggcaatcggaacgtttgtcggcgcgggcggactcggtgacatcattgtcaggggctcaaacgccacgaacggaaccgcgattattttggccggcgccattccgacagcgctgatggccgttatcgcagatcttgtgatggcatggctggagcgggcgctgagtccggtgagaaagaaaaaacgaaccaaagcgccgaatgcggcatgaaaaaaaaacgccttgcgggtcagggcgtttttttcttatggcttcggaacatgcttgaatatttcttcgctttcaaaaaactcgatcagacggctgatccagttgtagtaatcaagccaatcctttaattctttcagcagttcgttgattttttcctcagcttcttccggcacgccgttttcaaggacggctgtcagttcgcggttcagctttttatgcatcattttatttttgctgacgaccttgctccatgtggccgtaaacagcgtaataaaggtttggtaataatcctgctcgacgtcgtataaatctttgcggacgcctttttcaaacactttttccgccagattgacgtcaagcatttcacggaccgcctggctcattctcgttttgctcatgccggtcgcttctgataattcagttaaggtcatcggcttgcggttcatataaataatgcctaaaatgcgccccaccgtcgcgggcattccgaatgtatgcatattttcagcgattcgttctatcaaatgatcttcagcttgttcgattacgtgtaacggatctttctccaacagtttcaatcctttcagtcagcaattccgatgtcaatataccacatttttaaaccggcggaaatgctcttccgagagaatttggcagtaatccggagcaataagaagaactttgccggtcaatacgggttaatcagtgcttacacaacctttatatataatatggacaaattgtaaactttttaatttacaaagtttaatttataatgggaaacgttcaattgtctgaaaagttaaatttgaatttaacgaattgaataaacttaatcatggaggtgtaagtgtttgctgacattagaaaatgtctcgaaaatgtataaaggcgggaaaaaagccgtcaacagcatcaacctgaatatcgccaaaggcgaatttatttgttttatcggaccgagcggctgcggcaaaacgacgacgatgaaaatgatcaaccgcttaattgaaccgacagaaggcagaatcctgatagagggccgaaacattatggaacaagacccggtggaactcagaagaagcatcggctatgtcatccagcagatcgggctgtttccgcatatgaccattcagcagaacattacgctcgttccgaagcttttaaagcatcctgacgaaaaacggaaggaacgggcgcgggagcttttaaagctcgttgatatggggcctgaatatttagaccgttaccctcatgaactgagcggaggacagcagcagcgaataggtgtattacgggcacttgccgcagagccgccgctcatcttaatggatgaaccgttcggggcgcttgacccgattacgagagattcccttcaggaagaatttaaaaaactgcaaaaaaccttacataaaaccatcgtatttgttacccatgatatggacgaagccatcaagcttgcggacagaatcgtcattctgaaagcgggagaaatcgtccaggccggaacgcctgatgagattcttagatttccggcgaatgaatttgttgaggagtttatcggcaaggaacggctgattcaatcatccagccctgatattgaacgggtggagcagatcatgaatcccgatcccgtgacggtaacacctgagaaaacactgtcagccgccattcagctgatgcgtgccgagcgggtggattcgctgctcgtcattgatgaaaagaacgttctccaaggttatgtcgatgtggagatgattgaccgcaaacgaagacaagcggtaaccgtcgcggaagtgcttgagcgggatctgtacacggtcagaagcggcactctgctccgcgacgccgtccataaaattttaaaaagaggcatgaaatttgtgccggtccttgatgaagccggccgattaacgggaatcgtgacaagggcaagcctcgttgacatcgtctatgactccatctggggagaagagaatcagctcgcggtgatgtcatgaggaggcttcaattgatatgaatcagaccgtgcaatttttacaggcaaatggaggagagatgctttataaaacatgggagcatctatacatctcattaatcgccgtcatggcgggcattctcgccgccgttccgctcggcgtcctgctgacgaggatgaaaagaggagccggcgccgtcatcggcatcgtcaacatcattcaaaccttgccgagccttgccattcttgcgttttttattccgcttttaggcgtaggaaaggtcccggccgttgcggcgctgtttttctattccatgctgccgattctcagaaacacgtatacggggattctcggcgtcaatcggcatcttctggaatcgggaaaaggaatcggcatgacggcatgggagcagatcaggcttgtagagctcccgcttgccgctccggtcatcatggcgggcatcaggacgtcttcgatttatttaataggctgggcgacgctcgcctcctttatcggcggaggcgggctgggagattacatttttatcggcttgaacctttatcagccggagtatattatcgcaggcgccgttccggtcacagtgctggcggccgccgtcgattacatgctggggatgacagaacggaaagtcacgcctgacgggctgaagagcataaaggatgcttcataaggaggaggtctctcatggggaatagatgcaaaaaacggctgctcgcaatcgcctgtatcggcatgctgctccttggcggatgctcgctcccgggattgagcgccgcatcggaggataccattaaaatcggcgcgcaaagcatgaccgaatcagaaatcatcgcgagcatgctcggacagatgatcgaacatcacagcgggttgaaaacatccgttattaaaaatctcggttccaacgccgtacagcagcaatccttgatcaacggtgatattgatatcgccgctacgcgctatacaggtgacgcgctgaccgggacgcttcgcatggacccggaaaaagacccggacaaagcgctgcggctcgttcagcgtgaatttcaaagcagatatgacatgaaatggtttgattcttacggctttgataatacatacgtctttaccgtttccggacagcttgcccgcaagtaccatttagaatcggtatccgatgtcaaaaaagaagcgtctcatctgaaattcggcgtagataactactggatgaagctgagaggcaacggatatcaggattttatgaacacatacggaatgtcatttgaaggcacgtatccgatgcagatcggcctcgtttacgacgcgctgaaaagcagaaagatggatatcgcgctcgcttattccaccgacggaagaatcatcgcttacggactgaaaacgctgaaggatgataagcggttctttcctccgtatgactgttcacccgtcgttccggatcaagtattaaaagagcatcccgaactggagggcgtgatcaataaaatgatcggcgcgattgatacaaagatgatgcagaaaatgaattacgaagttgacggccgattaaaagagccgtccgtcgtggccaaggaatatttagaaaaacatcattactttgaataacggaaaggagatgtgcggatggacacgatgaaggagctatttacgtattacgctcaaaacggcagctatgttctgtatgagtgctggcggcactttctcatgtcggcgtacggcgtcgttttcgccgccgttttcgccattccggccggaattgtgacagccaggcacgggcgtctctccggctgggtgtttgctgtggcgaatgtgattcaaaccgttccggcgctggcgatgctcgccgtcctgatgcttgtcatgggactcggcgccaatacggtcatcacggctttgtttttgtattccctgctgccgattctcagaaatacgcacacgggcattatcaatatcgagcacgcttatctcgagtcgggaaaagcgatgggcatgacgaaataccaaatccttcgtatggtggagctgccgcttgcgctttccgtcattatggcggggctccgaacggcgctcgtcattgccatcggcatcacggcgatcggcaccttcgtcggggcgggcggcctcggcgatatgatcgtcagaggatcgaacgcgacaaacggaaccgccattattctggcgggcgccatcccgaccgcgctgatggcggtggccgcagacctgctgatggcgtggctggaacgagccctcagcccggtgaaaaaacaaaaaagaaagctgatcgtacgctcagcctcatgaaaaaaagcattcttccgcgggaaggatgctttttttgatttcttgattaaattttgataactgcgctgtaaagtcttacttatcaaataacaaagcagaggggtaatcaaatgagcaacatcatagaaacgagacagctgcaaaaatcattcggcagacaacaggcagtggctgatgtgtctctatcagtaaaacgcaacagtatatacggcctgctcggtccgaacggcgcgggaaaatcaacaacacttaaaatattgaccggcatgctgcagcaaacatccggcgaggtcctgttcgacggacatacatggaagcgcgaagacttgaaaagcatcggttccctgattgaagcgccgccgctttacagcaacctgacagccgctgaaaatctgaaagtccgctgcgtgatgctcggactgcctgattcaagaattgcggaagtgctggaaatcacgggattaacgggaaccggaaaaaagcgcgccggacaattttccatgggaatgaaacagcgtctcggcattgcgttagcattattaagccgtccgtcgctcttaattcttgatgagccgacaaacggattggacccgatgggaattcaggatttgcgggaatttatccgctccctccccggacagggcatgacggttattttatcaagccatctgttatcagaagtcgagcagatcgcagaccatatcgggatcatcagtgacggcgttttaggatatcagggagaaatcagccgggaagatgatctggagcagttgtttctggaggtagtcaaatcaacacgggagaaagcggggacaggaaaatgattcagtacatgcaggcggaacatcttacatctaaaagaacatttatcagaaagctcatcattctgattccgcttctgaacacggctttttcttttctgctgaatacggcttattttatgacgggcacgttcaattggtgggcggttattttcatgccgctcatgatttctctaatgtgcggtttatctgttaaaaaagagaaaaaatctgcgaatgaccgcgcggtgtactcattgccggcagatttaaaaagcatatggctctcaaaaataagcttgatcgcgctgtattcactcctgtcgcaaatcgtttttttcatcatcatgtttttacttggccttgtatttccgggaattgctgcgctgcagctgaaaggcgttgaagcaggctcccttttatggctgacgacgctttgggaaattccgttctgcttatggattgccagacagttcggatttacggcagtcattctcgtgaatatgatcgccgcttttgttttgggtattgtgccggcgtccggttcattgtggtggctgagcccatggagctggtcagtccgggtgatgtcaccgattctcgggatccatccgaacggaattccgcttcccgcagacagcggcttattaaacggaaacgtgatctttccggctattattctttctatcctttcttttatcgcaataagtttgatttccgcagtgtcttttgcaaaagggggaaaccggtcatgaccgtgcttttacgatatatgtgggccgatgtattaaaaatgaagcgcacgccgctcatatggatgcatgctgcggcgccggttttatgcgcgggatttttcctgttgtatatgtatggaagggttcaggagccttatatgctgtacagtgtgtttttcagcgcgattgctgttttataccctttaatcatcagtattgtctgcgggatgtctgcctcggttgaggaacaggcgggccattttcagatgatgctggcggtgccgtattcgaaaatcgtcagttttgcgggcaagctgcttttgctgctcctattgaatgtgttatcggcaggtctcgccatctgtctttatttggcggggatgaaatttgttcttcacatcaatgatctcccctatcttacgtttttaaaaggaggggcgtggctgattgccggcagtattccgctttatatgatgtctttttttgtcggcgtaaagtacggcatgggaccgtccgggcttttagggggtgcgggattattaatggcggcgctcatgaatacgggacttggcgatatcatctggcgttttttcccgtgggcatggagcgtgcggctttcaggccttgcaggactgctgcattttgacaaagtcaaaaaagagttcctcccttatgtaagatacgatatgagattcggagaaataatgttatatttttctatagtgatattatgtctggccggcctcttttggtgcagaagatgggaagggcggcgttcatatgaataaaggcaaggagcgattcggccggtggcaaacattttagcaattgatgatgaaaaagatattctcgttctgatcagaaacattttacagcgtgatcagcatacagtaacgattctggaaaaagcggaggatcagtcattggatttttttcaaggctatgatttgattcttctcgatgtcatgatgcccggaacggacgggattgaactctgccggcggattcggccgctggtggacagcccgatcctgtttttaacggcaaagtctgacgaagaatccattgtgaaaggcctcatgacaggcgctgatgattacatcacaaagccgttcggcgtacaggaattgatggcaagggtaaacgcgcatgtcagaagggaacggcgggaaaagcatcagacgaaacggctgatatcaggcttcatgtttgattttgacaataaagaagtgtggatggatgaccggaaactgcctcttacgaaaaacgaatataaaatcgttgaatttctggcacagcataaaaacagaacattctcacgggagcagatttacgaggaagtgtacggcttggacggcgatgcgctctattcaaccattacggagtttatcagaaccatccgtaaaaaatgtaaagaacacggggctgatccgatcaaaacggtgtggggtgtcggatacaaatgggaatagcaaaaggaaaatccagcatccgcaaagagcttgtcaaatttacgatcacactgtgtctgagcacgatgggggtggcggcattatgtgtcgccttaaatgccattgccatgaatgccggagcgatcctgcccgcaaactacagcgagcatgaggcggaacagatcaaaccccgcctgaaatcagcggaaaagataacagaagatatgatccccgcaggtatgacatacgccgtttttgataaaaaaacaaagcggatgacgaaaggaacgatgacggaacaagatgcggccaacgccagaaaaaagattcagcatcagccgtattttaattatgctcaaaaaggattcatggtgataaatcggaaagatgaatacggcgttctccaatattcactcaggtcggaatttcagtcgccgctgttaaggcgctatctgccgaattatgaatggacgggtcttacgattctgatcactttgcttcttttgaccgtttttatcgtgacgacgcgtttcgccaatcagctgagacggcatttcagcacactcagctccattacggcaagcattcaaaaacagaatttaaatatcaatccaaaaaggtcgcgtataaaagaatttgacgatgtcattgactctctgctgaaaatgaaagacgcgcttcaagcatctctggcggcgcagtgggaggcggagcggataaagaaagaacagatcggcgcgcttgcgcatgatattaaaattccggcaacgatcattaaaggaaatgccgagctgcttcagttaacagagcctgatgaggagcaggcggaatatgcgcagtatattctggatgccggaaacaaaatcgagcattatgtcggacagctgatccagctttccaaagcggaggaggcagttgccgttcatgtggaatatactgacctcaaagagtggattcaaaacatatatcgtgacgcggcggcgcttgcggggccgaagcagattgatctcgtcctcagcgaacggggaattgaccgaatagaagcgccgatcgatcatgagctgctccacagggcggtcatgaatatcgcggcaaatgccgtcgactatacgccggaaggaggagaaatccgtgtggacgtcctgtgcaccgattccgccctccatcttgccgtatccgacagcggaagcgggttctcgccggaagcgctgaaaagagcgacacagcttttttacacggaggataaaagcagacattcggcggggcatcacggcatggggcttacattcgcccatcatgtcgtacatcttcaccacggcgaattaatacttgaaaatcaggagtctggaggagcccgggcggagattcgaattccgctggaaggcgtcagacaaaaacaagccctgcacgtatgagggcttgttttttctgtttccatgtttctttgagaaaggcaaaaataaaaacggctgcccgtttgagagatcagccgcttatgcggaaaagagtttatcaggaaggatcaatccattgtgaagaccacttggaaatttcctctaaaataggggctaatgcgcagcctttttccgttaatgaatactcaatgcggacaggcgtttcggggataacatcccgtttgatgacaccttctgtttcaagttctttcagacgttctgacaagactcttccgcttaaattcggaagcgccgcttcaatttcgctaaatcgctgctgtccgttcaataactgaaagacgattagagccacccagcgtttacttaggatgtcgaccgctttttcgaatctggggcacatttctgattggttcatgctttttcacctcgtcttctgctattataccgcaaaatcggagggaacgtatgtctggcgctcgttaagttgggagggaatcaaaaagaggatgaggaatccggggagcgctttttcgcttcagccgcgataaaatcaaagtatttgctgacgctttcaatatcttcttttgtgaagtgctgccactttttgctgtcaaacagcggcagatgctccgcgcctctgtcaacggcggtctgatagatggcgcagatggattgatagctttcggatgtttcgcggatttcctcctgaaatgccttgatgtgtccggcccgcgccattaactcctcgtacggaatttttaatgtgtccgccaattttctgatggtcgcgggtttaggaatgccgcggtgcccgttttcaattctggaaatggtcgccgagctgacaccggaatagacggcaagctgattgacggtaagcttccgggcgcggcgcagctctcttaattgctttccgaatgtgttcaataagatcgcctcacatgtgcaaagtcatgagtcttcgtttgttctttttttggcttccgccgataagaacgcaaagtatttatcaagcagaaccaagtcttctttcgacaggtgccgccagttctcccgctccaatagggataaatcatgcagctcatacgtttcggctttttccagcaaggtgcagcccgtgtcgtacggggctctcgtttcctggacggtctctatgtatcccgccgtctgcatcagttcctcatacgggatttttaacgcatctgcgagctttttaatggttgcaggtttcggcaccccgcgtttgccgttttcaatccgcgagattcccgcggcgctgacgcctgaatacgttgccagctggttcactgtcagatgccttttttcccgcaatgtccgcaattgtttcccgaagctttccacagtctctccccctcccgcggtctatttatattctagtatgtttattgactaaagggaatagccaggctggaaaagtattgacaaaagttaacaaaagccgtatcttatgtataagaaagaaagtatttgacagaacggaaggtgaagaaagtggtcgaaaagatacagatcagaagagattatgtgctgcagtatatggtcaataatgactactcgttaaaccagctcgccctggagatcggaatatctcccgccacactgagccgtgtactgaatggagagcggaggccgggacagctggtcatcggaaaaatgctctattactttgacatgaaatttgaagatcttttttactacgactttgttgacaaaagtcaatgatgatggaagattcaaacgcatttccgtttttctgacatgatgtataccgatacggcgtgacatgcctttgcttttcatgtaaaatagaagcaatgtaggccagtcagtctggaggtgtatggaatgcacacattattgattaccttattggttatcgtcagtattgcacttattattgtcgtattgcttcaaaccagcaaaagcgccggtttatcgggtgcaatttcaggcggggcggagcagcttttcggaaaacagaaagcaaggggccttgatctgattcttcaccgcacaaccgttgtgctggcagtcttgtttttcgtgttgacgatttcgctggcgtatatcgtataaggcaatgtttgtataaggtctgatttaatatcaggcctttttcttgttgagagacggcgtttgtttctcgcaaaactgtggaaaactaaattgaatgtgcaaaaaaggggttatgagcatgaaaattgtgacaccaaaaccatttacatttaaaggcggagacaaagcggtgcttctgctgcacggatttacgggaaatacggcagacgtcagaatgctcggccgctacttgaatgagcgcggctacacttgtcacgcgcctcaatataaagggcacggcgttccgccggaagagctggtacatacggggcctgaagattggtggaaagacgtcatggacggttatgaatatttacggtctgaaggctatgaaaacattgcggcctgcggactgtcgctgggcggggttttttcattgaaattgggttacactgtacccataaagggaattgttcctatgtgtgcgccgatgcacattaaaagtgaagaggttatgtacgaaggagttctttcctacgcgcgcaattataaaaaattcgaaggaaaacagccggagcagattgaaaaggaaatgaaggagtttgaaaaaacaccgatgaatacgctcaaatcgcttcaagagctgattgccgatgtgcgcaaaaacgtcgacatgatctattccccgacatttgtggttcaggcacggcatgaccatatgatcaatacagaaagtgcgaacatcatttacaacgaggtggaaacggacgacaaacagctgaaatggtatgaagaatcaggccatgtcatcacgcttgataaagaacgggacctcgttcatcaggatgtgtacgaatttttagagaaactcgattggtaacaaacaggaggtcgaataatggaaaaagaagcgtttatggaccgtcttctcgcgtttatgaaggaagaggcgtacaagccccttaccgttcaggaactcgaggagatgctgaacatcacggaagcagatgaatttaaagagctggtaaaagcgctggtggcgctcgaggagacgggacagatcgtccgcaccagaagcaaccgctacgggcttccggaaaaaatgaatttagtaaaaggaaaaatttccgcgcatgcgaagggattcgcgtttctattgccggaggatacctctttaagcgatgtgtttattccgccgaatgagctgaatacggccatgaacggcgatatcgtcatggtgcggctcaattcccagtcaagcggatcgagacaggaaggcacggtcatccgcatcctggaaagaagcatcgaccgcgtcgtgggcacatacacagaaacgaaaagcttcggctttgtcatcccggatgataagaaaatcacgagtgatatttttattccgaaacatgccaataacggcgctgcggaaggccataaagtcgtcgtcaaactgacaagctaccctgaaggcagaatgaacgccgaaggagaaatcgttgaaatactcggccataaaaatgatccgggcatcgatattttatcaattatccataagcacggcctgccgggggactttccggctgaagcgatggagcaggcaacaagcacgccggataccatcgatgaaaaagacatcaaaaaccgccgtgatctccgcgatcaggtcattgtcaccattgacggcgcggatgcgaaggatctggatgacgccgtcaccgtgacaaagcttgataacagcagctacaagctcggcgtccatattgccgacgtcagccattacgtcacggagaattccccgattgataaagaagcgctggaaagagggacaagcgtatacttggttgaccgggtcattccgatgattcctcacagactgtctaacggaatctgttctttaaatccgaaggtcgaccggctgacgctttcctgcgaaatgacaatcaaccagcagggacaggtaacggagcacgagatcttccaaagcgtcatcaaaacgacggaaagaatgacctattcagatgtcaaccggatcctcacagaagacgacgccgagctgaaagaaagatatgagccgctcgtcccgatgtttaaagacatggaacgtctggcggaaattctccgggcgaaacggatggaccgcggcgccgtggattttgatttcaaagaggcgaaggtgctcgtcgataaggaaggcgccgtaaaagacgtcgtcatcagagagcgctcagtagcggaaaagctgatcgaagaattcatgcttgtcgcaaacgaaacggtggccgagcacttccattggatgaacgtgccgtttatttaccggattcacgaagagccgaacgccgaaaaactgcaaaagttcctggagttcgtcacgacattcggttatatcgtcaaagggaaagccggagacattcatccgcgcgcgctgcaaagcattcttgatgaagtacgggaccgtccggaagaaacggtgatttcaacggtcatgctccgttccatgaagcaggcgaaatacgacccgcaaagcctgggccatttcgggctggcgactgagttttatacacacttcacatcgccgatccgccgttatcctgacttaatcgttcacaggctgatcagaacgtatttgatcaacggacaatcggacgaagcgactcaagaaaagtgggccgaacgccttccggaaatcgctgatcatacgtcaacgatggaacgtcgcgccgttgacgccgagcgggaaacggacgatctgaaaaaagcggaatatatgcttgataaaatcggcgaggaatttgacggcatgatcagttccgtcacgaatttcggaatgttcgtcgagctgccgaatacgattgaagggcttgtgcacgtcagctttatgacggatgattattaccgttttgacgagcagcatttcgccatgatcggtgaacgcacgggcaacgtttaccgcatcggagacgaaatcacggtcaaagtcgtcgacgtcaataaagatgagagaaacatcgactttgaaattgtcggcatgaaaggcacccgccgtccgagagaaacaacaggcgaccgcagaaaacgaggcagaccggcgcggaaacgcgtgttaaacagcaataccccggcttcaccgccgaaatcggaggaaaaaggggaatggtttacaaaaccgaagaagaaaaagaaaaaacgcggtttccaaaacgcgccgaaacaaaaacgcaaaaagaagaagtaaatgcgaaaagcaaatggggcaaaatgctctgtttgctttctttcgcaagccgcattttcattgtcgcggaacgctccatttgctaaaataaagcgtatcgcacacatgaacggtttttgcggagagaggaggataaggcatgccaaaaggatcaggcaaagtattatcgcaaaacaaaaaagcaaaccatgattactttatagaagaaacctatgaaacaggcatcgtgctgcagggaacggagattaagtccatccgcgccggccgcgtaaacatgaaggattcctttgcgaaaatcgaacgcggcgaagtgttcctccacaacatgcacatcagcccgtacgagcagggaaaccgctataaccatgacccgctccggacgagaaagcttttgatgcaccggaaagaaatcaataagctgatcggcctgacgaaagagaaaggctattccctcgtgccgctgaagctgtatttgaaaaacggctttgccaaagtgttaatcggcctcggaaaagggaagaaaacatacgataaacgcgaagatttaaaacgaaaagacgccaaaagagaaatcgaaagagcgttcagagacagacaaaaaggcttctgatgcatgagccttgatgtgatgatatgccctgtgctatactgttcacacatcagattcacaggctgtttattgaagacattcccaattgaatttgcctgtgatcatggtataataacagtacagccagttgagcaagagcttgatagatctcccgtatacccttaacaaggggacgttacggattcgacagggatggatcgagcttgagctgcgagccgagaggcgatctcgttaacacgcacctaaatataactggcaaaactaaaagttttaaccaaaacttagcactagctgcctaataaacgcagcgagctcttcctgacattgcctatgtgtccgtgaagagcacatccaagtaggctacgcttgcgttcccgtctgagaacgtaagaagagactgacagactagctctcggaaggcccgcccgcaggcacgaagacgagtgaaacacgaaatatgcaggctacgctcgtagacgcttaagtaatcgatgtttctggacgtgggttcgactcccaccgtctccatacataacgccaaaaccgcagtgttatcaaggcttctgaagctttcgatggcactgcggtaacattttggtaacactttttaaaattcttcgttttccatgtggtctacaatttccctttgtgctgaaggataaaggtgactgtatgtgtttaaagtttctgccacgtttttgtgacctagcctctgagcaatgatgagcgggttgctttttttatggattaaataagatgcatgggaatgtctgaattcatgaatcagaattcttttaacaccagacagttttatgtatttttcataccgtctatctatggtgctggttgcaatgctgtcatagaatgaaccaaaaactcgataatctggtttgactggcgctgtttcctccgcgcttttttttatgtcctttaataagtccatgactttttgaggcatcataattattctgatagatgattttgttttaggcttggtaacctcccggttatattctgttttatttatgtcgatcaaattgttttcaaaatcgacgtcggcccagttcaatgccaacaattcaccttttcgcgccccgctgaaatataaagtcgagaaaaaggctttatataaattgtcgtcaactacagaaataaaccttttaaattcatcgaattcccaataattaaaccgtttgtttacttccatttcaaaattcccggcaacctttgcggggttgttttttgtattatggaacttaatcgagaaattgaataccgccgaaagtgttgaatgaatcttttttagaaagtccggggaatataaatcaataattttgttttgatatagcatcacttttttaggtgtgattgattcgattttagtatttccaaactctttgatcaggtgattgaataaaatgttcttgattacgttgatggatgatgtttttcgtctcgctttgtaccatgtgaaatatgtttcagcagcttctgaaaatgtaattgatgaaccctgttcttcatagcttaccaacatttttctttctgcatcttttgctgccttttttgttttaaaaccacgccgtttcacttgtttaagagatccatcattctgaggtacacggcatacaaaataaaacgtcttcttattttcttctggataaacaggcatacgttccctccttaccgtaggacaatgaactcagttttactttataagatagcatgtgatcctttctttgaaaagaatatgaggtgaaatatcatgttaaaaaggtatgaatacttatacttttaattacatatatggtataattaagtattgaaagaatttttttctttagaaatattgcaaaattctaaattttatcgccaccgttcgacaaaattctctttgtgattatgttaaatttgagttgaaaaggtgatcatatgggaacaattgcagccagagatataagagtacatctaaaagaaatgattaaatcatccgacgaaaagcaaaatctgatagctactaaaatcgggataagcgaaggatatttgagtaaatttctcagtggaaaagaaataaacttttggatggttcgagagatcgtaaagtatcttgacccagagaatgaaactgaattgatggaacggcattgtttaagcggagtgaagaagaagaattatgcttctgctttagaatattgttatgcaaaacggcttttttcggtcgttgaatcgttgattaaaaatcagatagcccgagatggaaaatctgacttatggtcaaaaatctatagattcatccttgattttcgattatctgatggaaatatagagtacattgaaaaccttaaagaactaaaatcaaattcggatgaaacaaaggtgttactatatatcttagagatgtacggtaatttttataatggcaggtttgagataactctatatcaaatagaatctattaaaatcttgatttctgagttgagtgatccattcttaaaaatggcttattcggcccgcgttgaagaagttttagttaatatctatttgaaacagaaaaacaatgttaataaggcgagggaagtagctcactcgcttttggaaaagaatcttagtgtcaatctaaatatgacagcgttatacatattggctttatcctatgtatatgaatcctattctgcatcctatcactactacatggaagtcataacgttactcaggaaattccctgacagagaagacgagttgatacagaataaagaagaaatagcaatactccagcgttactgggacaaagaaatatcagaagatttttgtgtcactgaatttgcaaaagcattggcagaaaagaaagtcctcaataaattttataaacatgagacatacaaaaaatatgctttattgtttgatggtaagaaagaggaatcttcagagaaattactgttatctctttattttttttcacagcaacaagaccaattcagggcaacacttccaaaaatacacttgataaaattaggttttaattttaatatgtagtatcaggaggtgttgcaaatgagaaaaatgctattaactctatccctagtgttcggtatactggctctttcttataccaatgtgagttttactcatacagcaaaaggcgaatttcaaactgccgagattagagtaggagcataaatcattgccacctgaaaagtatataatcttttaaaaaaagacgctgccgtaacgggcaacgtctttcgtacttttcggggatatttcctgttttcaaaaaaaacgaaaacaggaaattcttgaaaaagtgtttattttgaaattgatattaaatataatgggaacaagcgttctttttgaaaggggaaacatcatgcacatttcatatgaaaacatcatcgggaatttgaaaaaggaaattgaaaaggagaaaaatgcagacacaaaaaaactgaaagttggttaatctaggtctttcaaatgccgttcttttaattcccttaattctttcaaatagtttataaccatttgtaattcttcttctgtaatcttgcttccgttatcatgaacaatatttaactttttaaggtcatctatcgtgatactcttttgagcgagaagttgcttttcaggttctgagtattttttcaaactctcttcatcaaaaaacaagtatgatttatgaacgcctaaataatcagcgatattttctataacctgcattgatggttgttgtatatttctttcaatgcgcgaaagataactttgcgtaattcctattgaagcagccatttcttctatggttctcttcttctcttttctaaggcgacgtatagcttcccctaattttagattttccataacaaacacccgctttttttaaaaataaccctcttacctataggtaattatatcacagggtattcctcacaagaaattttttttggaaaactcttgtataaaaaatccctctgtggtaacctaaaaatatacctgacaggaattaaaaagggtgtgattgaaatatttcgtcttaatgaatttggacaaatgattaaggaattaagaaaaaaacgtaaaatgacacaaaatgattttgctcaattacttggatttactgcttcttatatctctcgtatagagagcgggaaagcaaatccaacgttaaaggctattgaacaaatggaaaaaaagttacgtataagaattttttttgagtatcaatagtcctgtcaggtatattttagggggaggtaataattttgtatctgaatctttttatcgctcgcaaagaaaaacgaaaatcgcaaaatgatgtagctcaatatctaaacattaacaagcagacttattacctgaaagaaaagggagtaagtgattttacaatcaaagaaggtcaaaaattagctgtttactttggccgtaccttggatgagttatttcaaaaatcataagtggggaggatgttaatttatggaacaacttcttaatgttagtctgtctattcccattccagctgataaagtccttatcagcaaagtagaactgcaagaactaagggatcaatcactatcgggggtttattggaacatgaaagaccttgaaaaaaagataggacgtaaaagcgaatggatcaaggaaaacattttatatccaagtcgtttccgatgctttttagattccgcaaatggaggttttgttttttatccacagactaaggggcaaagctggagctttcaggcacctaaaatggctgcctttttagataaacactttgctgagattttcaacaaataacggaaaggagaatacatgtgtttttagaaagccgcgtccggctgcataatcaaattcacgtaattataagcgagtctgttaatactcacgaaaaggcaattgccgaactaaaagctcaaggcggcacctgcctgtctgatcaatgtcagcaaaacaccctcggctctgtaatcgtaaacggcaaacggtctgtatggtctttgacgaaggcagagaccgcaacgcaaggagggagaaacaatggctaaatatcgccacgtaagaaccgaattttggcaagatccgaaagtgcttgaggaaatgacaccagaagataggtacttttatctgtatctattgacgaatccattcacctcacaaataggcatttactcgatcaccaagaagcaaatggcttttgatattggacactctattgagtccataaacagccttatggatcggtttcagcatcatcatcatttggtcgaatacaatccgggtacccgagaaattgccattttaaaatgggggcgttacaacctcaataaagccgggaagcctatgctggattgcatagaaaaagagttacgagaggtaaaggatcgttcactaatcgaattggtttatccgcatataccgaacgagtctatcagggaactgttttcacgatacgttgacgatacgtgtcacgatacgtcgacgtcaaggggacaaaaagaaaaagaaaaagaaaaagaaaaagaaaagaatatatatgtccccaaattgaaatttgaggacgtccacatgaatttggcaaagctcttattttctcttattcagcggaacaacccaaaagcgaaggtccctaaccttgacaaatgggctaatcgttttcgcttgatgatggagaacagagagcagccgcgaacatacgaagaaattaaagacatgatcatatggacgcaaaaccatgacttttggtttgcgaatatcttatcagctgataagctcaatcaaaaattcgatgaccttactatgcaaatgaaacgcgaacgggggaatggaccacatggaggacttcacaaaggagcaggcagcagcagtagagggcgaaatatctcgcaggatgatattccatactgacaagcacggcaaccccatttactgtgacaaacacactcgaataataggcggagaagaaaaaccgtatccagttcagctcatgaaactttggaacggctctgtaaagtgtcctatgtgcgaaagggagcaacgcaataaggagattgagcaagaagctgaggtttggcgccgccaggtagagagaagggttctttctacacactcactcattgccgatccaactctggaaaaggcaacgtttgaaacatatcactgttacaaccaggaggatgaacagaacaaacgccggatgcttgaactggttgatcagatcaaagcgggtgtaatcatgaacatatttataaccggtgtgtccaatgccggcaaaagtcatctggcaatatcagcacttaaagaactgaacaaaaagagtcaagaagcatatgcaaaatcagctctttttgttaatagtgacgcactcatgcggcgcataaaaaattctttcaacgatgattctgaaaaacttacggagtccaaggcgatcgaactgctcacacgagtcgattatcttgtcatcgacgacttggggagtgaagtgggcgacacagataacgagaaaaggacagcctctgatttcattcagagggtctggtatgggatctctactggaaggcaaggcaaggtgacgattgtaacaacaaacctcacaggattggctttagcaaagctttatgacaaaaagaccgtcaaccgccttacggcccatcttgaaaaaattgagtttgaagaggcgcaaaaaggcaaaggccgcaagacaccggcttcgctggtttaaggaggtgaaaacagttgatacaggcaatcatgcccggcgtgctgcagatcgtccctgaacgcaaattaacggatgaccagcgcaaaaaagaaatagacgagcttatcaaggttcttgatcaaaaaatagcagactatcagaactttagggggaatgcagtgtgaaacacgggaagcgcccgacgcgcgcacagaaaaatgtcattaaggcaaacggcttaaacccgaataactggcttgtaagcaaaaatctgcagcatgaacaccgtcttattatcgtccatcggaatacaggaacggtccggaggtgttgggcatgagtcaggcggtcaatgctgaaccgttcgaactggctttggaggatatgaattatgaatggtcaatggtccagctaaaaaaggtcgttcaatactggcatgatgggaaatcaattcttgatatgtcggaattattaaacagagattcggatgaaatcattttgctggtcatggactttgcaagaaaaaacatcctgcccgcccgtaaaaacggcttacgcgctaacaaaagaattagaatatccgagaaaacgatgaaagataaaatgtaccgactacgctatttgtttgaagaaagcccggtgtatatcccttttcaggacctaaacttcatgttttatgacagtgaaatcaggcgtttccgggagctgtgggcggcagatgagtcttacctcaacatagcaaaagagctgaaacggaatgaagatgaaacgttattccttatcatcgaccaagcaaaaagagacctcattgagcctcgggaatccggcttgctcggaaaggaagcgtcagaagatgaacgcaacaagcaaaagcttccattttgaaaaagcaaccgtccagcaacttatggtcatcgtgcgatatgaagactgtaccccagaggtaaggaacgcggctttacaaatgctgattatgaagggagtggcagacgtttgggacaggcagaacgaaagcatttaatggaatggcttttgcttatcggctcttatggcagagattttttaaaccgccagacagatgaagagcttgagcgcttatataatcttcaaatcaaaggcatgaataaagaataggaggacagcaccatgacagaaaacaaaaacttgcgtcggcacggagaagttacaacacgggtgatgagcgaagaggaacgcgttgagtatataaaaaaacacccaatcattccgacggaaaaaccaaaggctggtatgcagctcttcccgtcaaaatattggatgtaaggacggccgctaaagcaaccgccaccgtatgaataataaaacctagacacttttattataccatacggaggctttgaacatgcagccaaaacatataccaatcaatcaaaatacaggtatttctcaatttattgagccggggaaggtgtctgtcatcgtgttagacggcaaccaaaacgccgcgtatgtcgttgaggcacccgaacacggcaaaacaatcattcaaacagtaaaaggcggcctggctcgttgtgattacgagatcggccataaattcaattagcaggggtttccccctgcgagggaggaacggaaaatgtatcgaaacgaaattgcccgcaagtgtgaacgctgcggaaaaatatattattcagctcattgggttgtatgtaaaacatgtcttttagaccgggaggcccgggcatgaaagaattcaaaatcaacttatcaaaaggtgaagttttatataccggctcttacatttgcaccctttcgaaaacggcggccagtacaccggagccaatttctttggaagcagcagccgaaaagctcgcggaagagttaatcatgcagcaggctatgaatcgggagcatcagcggcagcaagatattgcggccaatcaattccggcaggcacagaaagatattaagttgctgcaggcggagaacaagcgttatagaaacgcattagaattttacgctgatgacacgacatacacaaatgaatttgaagactgtccgcccgctattgatatggattggggcgccgttgcgaaaatagcattggagggggctgcggaatgaaaattacagtagacaaaaaagtgaagaagttctatctagcctttagtaatacacgtaagccaaaggatggcaaatggaagccggcggttggccatgaaattcaagttggaaaataccgtttctgcgcgattccaactttcgatcatattaacgtgtcagaggtaacaaccggactacagattcttaaaattccgatgaccccttcaatctatcaaaagacactcgacaaagaagacacactgaaactttttgaaagtgtcggtgaggatttaatcaaaatcattaaaaagcaaagtgcggctgatcttgataaaagtcttattgagaaaagaagaatcatattcagcatgcttggcgaaatgccgccgattgaagtttttgacatggagggtgctgcaaaatgatgccattacaagtagaactgcaacggaatgtgaaggccacgaaggacgaagcaatgaccgtcgagcaggcggccgagcttttaaaggttcacccggactacatcccgacgcttgtcgctcggtctgacgatctgaaaatgatcggcgataccattatcgctaaacgggataaaacaaatatttggctggtcggggcatgcgtgggactcatcttcttcactatctccgtgttgccgggaatgttggggtgacgggatgaaaagtattgaattgttcgccggcattggggggatcgctcttgccgctgaatgggccggcgttgagacggtagcattctgcgagcgtgaacccttttgtcaaaaggtattaaacaaaaatttcccgggcgtacctatcttcgatgatgtatgcaccttgaatagacagcttttagaagaaaaaggagtgattgagccaggtggaacaattgacattatttcagggggattcccttgccagccttacagtattgccgggaagcgaagaggcacggaagatgaccgcgacctctggccggaaatgtttaggatcatcaaagagcttagacccacttgggttgttggtgaaaacgttgctaacttcgcaaacatggaactcgaccgcacgctatttgacttggaaagtgcgggttacaaagggcaatcgtttattataccggcttgtgccgtcgacgccaaacatcgaagagatcgaactttcgttgttgcctactccgacagcttcggacggcacaacaggcaaaataatagggaagaacgacaatttcacaatcaactcatcgggaacgctacggaagaggacaggcaacggaacagacggatcaataggcctggggaggtatgttcagtttttcccgaccccgcagtcaagagattacagatcgggagacaagcccaattcgaaacgtgcacagaggaagacggagcagggatggagtctcaatctaaacgattctgtgatgtggcccactccgagaacaaaagggatgtgcggcggcacgggatcttttcaaacgatgtgcgaactacaggaaaagggagttatttcagagcaggaacggaaacagatgacggcgggcaatgctgggcaactgaacccgacgtgggtcgagtggctcatggggttcccgatcgggtggacagaattaaaggattaggaaacgcggttgtgccgcagcagatttacccgatatttaaggcaattatggaccaggagactgcatcatgatcgaataccattgcccggactgcgattataaaaaacttgatttagaaatccgcgcagatgcccgctgcccgcattgtgggcgctgcatgggcgttgaggaggaaatagtgtgactttacttgatgacatcggcttcacagaggagcaatatcgagagcttcatgaacgcggtatgtctgacacggaaatagcgagagaggaactgcattgctctccatccactctttctgtctggaaaaaggctaacggcatagtaatccagaaaccgtatcgcctgttcactctggcagaatggacggagcttcgtaaccagaattggacacacttccaaattgcacagcatttcggtttcgaatgtattgatacttatttctatcatgcaagaaaaataggcattccgcgtaaacggagaagggagaaagttgaatcatgaatctacaaaaaatgttcgaaatgcaaaaggtgcttgatgatcggatcatcaaagaaaaggggcttgaggggcaggacttgctaccgaacctcattcttgctctacaggtcgagcttgccgagtgtgcgaatgaatggcgcggctttaagcattggagtaataaccaaaagccaagaacaaaagtatcaacaaatgttggtgcgaatcctgaaaacgcagcctttttccgttgtgaaaatcactattgcggagaaaatttaaacaaagatgattttaaacacttattagatccggattatgaaatatgtcctgtttgtaacgtgggtgatgtaacggcttttcgtgataaaaacccactacttgaggaatacgtggactgcctacattttgtcttgagtattgggaatcgaattggatatgcacacgaaaatttagggaagtggactgacttcactattgtaaaccagtttaaccacttgtttggatatgcatcggacttatataaagcaatacatgaagattggtttgaagaaaagttatttgatacttacgatgagttttttgcgggttttatcggtctaggtaaaatgtttgggttaacgcatgaacaaattgaagcggcttacatggacaaaaacgccgtcaatcatcagcggcagcaggagggcaaatgaaatgaaaaaacacacgattagaacaaaagacggattgcgggtcgacttcaaaaatgcagaaaaaatattaaaagaggttcctgaatttttggaggtaatggccgcattacctctatgggatgaattgtctttgaaaatagaagggacaacgaacgttactttcacacacattttatcagccgatgttgagtatttctttgatgaagaatcttgtgaaagctaccttgaagtaacaattacgtcaagtccgcttatggatgatcaagaggaaatagcgtttgaagagccggagggggaaaaatgacaaacgatcagatgagagacaaggtcagacatatgataagtgccggatatgaagacggaggaattgccgaatatgatgagtacaataacatgcttcaggacttctttgagaacgaactaattgacttacttccgaaaaaagcgcttcaatgcatcatagaaaagtttgaggagatacacgaatccggaccatgggatggttgtcttttgacagggaattattgaggagggcgcggaacaatgacagaaaacgaagaactgcaagcaaggtgcatcgaactggaaacgcgtaacgaagatttagcgcggacgattcaggagcaaaacaaaatgatccgggggcaaaactggcgaattctgtctttcgccctctcttggattgtatatggcgctgtgagtgctgtgaattatttctgggggtgatggaatgaaattcacatttagaatgttgatgcttctcatgatgtcggtcattgccaattccataggagcaatcctggatcagtatttcgacaatcagagttcgagaataaattgtgtggcagttgccgcagttatcagtgggtacttggttcgtggatggtggccgttaaaaaagaaggagggcgcggaatgacaaagacaaaaatcataatcaaaacaagcgataaggttgaggtcacacgggaacaggcgcgggcgatagaggaaggcatgaagttttatttgaaaatggctgatgacgaacctgaaagagtgaacacgttgaccaaaggagacaaaaaagaatttgcgcgccttcaattcgtcgggaaacactttgtcattaaaataggtgatgtcgaaccgtggaccggattgtttgatccgctgaacagcatgtctgcttatgatctaaataaggcgattttgaagggatatatcgttaagggggaagaatgatgatcaacaaagtcgtaatcgaaatcacagcagaaaaaggcaattgtgaaattgtttaacgagaatggggaagaaattaacaggcaggaaacttcaccaacagaaagcggatcaagtatccagtatacaggcgccgactttgaagacatgacagcagaagaaggcatgacagacgaactgtgggaagcgttggagcagaatttttatgtccatgatgtattaacagcaatgaggggagagtaatcatgaaaaaactattcaaatcaatcattctatcagctgcattacttacgggagcggtggcggttgcgccgtctgcttccgcagcatggtcaggctggcaaaatgaatctaggtacagcggccgggtgtttacggatgccgcgacttacacggccggcgcctcaacggtggactggaaagccgagaaaaaaggatcaagcacactttattacacggccggcgtatacaagaagcgaagcggcggcgggctgactgatacgaacttagtacagcggggcagcttcaaaacggcaacgcctctgaaatcattcaacgtgaaaacgatccggaataagaccgggaaaggaacatatgtcatccagctggactgctactctgattccggcaagcggaactatattggaacatttgaatcagcaaaattttacgtgaagtaatcaaaaatcaatatgtccaagacggagagcctgcggacactgatcattgcacagaatcactgtgctctgattggtgtccgttttttatttgaacggagggacggcatgaaaacgaagaaaaacgccacgctgagcattgattttaaagaaaaacagccatcgtcacacaaaagtatcgaaaaaaagccgcagaagcttactgagagagagttggagaacctcatgggtgtaaacaggcctacatataaaagaggccgtggtggagcttttagacagaaataataacgggagggatttttgatgaatcaaatgacactgaacatacctcaaattgacgaagaagctacgagaatgaaagctgaaaagctgctcgaacaatatcgcatgtacttactacaagtgccggaagattttttgccgaaagtgaccgcaacatacagccttgttccacccagcttttcgaatgaatttcattcctccacagaagacgcagcattaaaacgcatggattgggaaattgagagggaacggtttttaaagagaatgcaaagagcggttaaccggctttcccaaaaggagcggcaaatacttgtcatgctctatatgcagaatgaagaaatgtatgattatgaagtctatgcagagatgagactcagtcagcggagctactaccggacgaaagcaaaagcattttaccggctggcctttgctcttcgcgtggaagtttataaggacgggggcgcgccggaatgaattttgttcagcctataagggacttagatcagatatattatattaaaaagtacctgaaagaacggagcgaacggaatcaccttctttttgtggccggaattaattcaggtctgcgtatatcagacttgcggcttttaagggttagggacgtgaagcgcatgtatatcgacctgcgagagcaaaagaccagtaaacaaaagcgaatcaaaatcaataaagcattaaggaaggcttttgccgattatatcaaggacaaggatgatcaagaattcttattcaaaagccgcgaaggactaaataaaccgataagccgcagtatggcatataatattttaagggaagcggctgattatgttggtcttgatggtatcgggactcatacaatgagaaaaaccttcggatactggcactataagaaattcaaagacgttgccttgctgcaggagatatttaatcattcaagccctgacattacgctcagatacatcggaattactcaagacaccatggatcaaacaatggatgcattcagcttataagctcatctgtttaaaaaacagacgggctttttttatgctttttcctatgaataaaccatattgagaaaatgtcaaactcatttcagagaaatgaattaaacatagtggtggcaaaggattcagcgattcggggaattggacacaatataagttatgattaattgggttatgtggaaaatcttgtacacctttcgtggtatcatcgtgttacaggaggtgagcggcatgagtagaggcgcaacaggttcagcgttagaagagaaaggcatggtttgatataacgataccaagtaatgaaggggtgagcgggatgactgctgcagagcaaaaaggaatgtactaaaaagattttggcagaaagatggcacgataacggcacaccattttgttttagataaggtattatggtaataggtaataaatcaaaggaagcggcactgctgatgagcggggtcgcttttttatgttctctgtaaactgcgtccggtaagtctcaggatagacaatcggcggttaacggcttgagtgcgggggcagtttagaaagaatatgaaggaggataagcatgagtgttgtaaaaggattgacgcattgcaccttcagaccattgaaaaagtgtactgtgcagccgttgggtgtaatgcccaattggttgcataatgaacgcagagcagaagatttaaaggcagctattaatagatacattgacgcaaactgcgagattcccactgaatggattgaggaatacaatttgttgattagttcgattagagctgaaggggtgaatgagtaatgaaaaatatattgagaaacaaggtctatgagcaagcgcgttatgctttagaagagaaaatacctactcttgaagaatcaattaaaggcatagatcaaagaattgaacggctaaaaaagcaaaaggaacgtctttgtgaaatgttagatgaagacaagggctttgtagaagaggctattgaaaaatttgattttgttaaacaattctttttaggtgaacggggtctcgattgtggctatctgctgtttttgaataaagaattcctagccgataaggatggatattcataccaagatgcgatcaaaaaaagagatgaggatagacatgaaatgccggttaatgatgctgtagccgaaacactttattgtgatgatcaaaaattcacaactatacattttcctcatgggggcattcaatcatgaagaaagctttaaagccctgcaatgaacccggctgtcctagcctgacgcgagagggctactgtgaacagcataagcgaatcaagtcggcctatgatcaataccgggagtctgctgccaaacgggggtataacagcaagtggaggcaggcgcgcgctggctacctgtccaagcatccgttatgtgctgcctgcttgatgcaaggcagaagaaccccggcgacagttgtcgatcatatcgttccgcataaaggcgacaaaaaactattctgggactcgggtaactggcagcctctctgcgggccgtgccatagccggaagacggcaaaggaggatggaggatttgggaacagaacatcaaacgtgcgtgtgtgatcaatgcatgaccagacttcttatcaaaggctgttcaaagatcaggaagcacgacaacggaatcaaagagcattacatcaagtgtccacgctgcaaggcagagtatacatccttctatacaaacgaggacatcagacgaatgcagcacagaataagaaagatgtttgctcttcgtcgtaacatgaaaaaggaatcagctgttgatctatattcaaagaaaatagaagcagcacaaacagaaattcaaacagccatgagccagctgaagaaggagatggagaccccccacccttaaatccctagaggacgtttgccggagaccgcgctcccctccccattttgataaattccctaaatgaaaaatcggaaggaggtgagggaatggccagaccgcggcaacctgtggattttttactttataaaggcaagaaaaacttgacaaagcaagagattgaggaacgcagggaacaagaaataaaggcgccgagcgacaaagtgaaagctccatcatatttgccaaaagacttaaaaagagagtttaaaaagatagcggatgagcttaaaaacatcggaattatgactaatttagatgttgatgcgctcgcccgttttttgtttgctcgaaaattatatctgcaagtaacggagcagttgcttgaacgaggaccaatgaaaacagtgatcattagaaaaatggatgatgacggaaatgtaataggagaagaagaaaaaattgttccgaatgatgactattccgatcttttaatcaatcaggacaagctttttaaacaatgcaggcaagcttctagtgatttggggttaaccatttcctctcgttgtaaacttgtcatcccgaaaaaagatgacggaaaacagaaaactaaagaggaagaacggttcgggggccgcgtgtaatgcaagagataactgctgaaattctcattgagcgggtttggtcatatgctgagaaaattcgttccggggaaattaaggcaggcaaaaagcaaaaatgggctgtagagcgtttttttaaagatgttgaccagctcgcagaagatgactgcccttattactttgatgctgaagctgttgtggatttttatgaatggtcgcggcaatttaatcatgtcgaaggtatacttgcagggcagccgattgaattaacagactttcagctttttattgcggccaatatatacggattccataaaaaagaaaatggcgcccgccggttccggaaagcttatatccagctggcacgtaaaaatgcgaaatcgcaatttttagctttaatagcgtcgtatgagattttcccgacacaagaaaaacaccgggtatttatcgcaggctggtcccgcgaacaatcagacgaagtatatcaagcaattcttgagcagctgcatcacgcgccgatactcaaagggaaatacacctctgctaatggccgcgtgaaaaaatataaaacaaactccattatccagcctctttcccgtgaggcccggaagctcggggatggtaaaaacccatcattgggaattgtggatgaataccacgcacatgaaacaagtgagatttacgatgtcctggacagcgggatggtcgcccggcgcagtccgttaatggctgttattacgacagcgggtttcaacatggagcggccatgctttaaggaatatcaatatacgagtaaaattcttgatccagacattgatacggagaatgatgattattttgttatgatctgtgagcttgatccagaggacgatataaaagatgaatcaaactggattaaggccaacccgattgtggcaacgtaccccgaggggatggagtcattacgttctgctttaaaagtggctcttgaagtgcctgaaaagatgcgcagtttcctcaccaaaaatatgaaccgatgggttgaccagaaggacaatggttatatgaatatgacaaaatggcgcgcttgcagcggggaaattcctgatctgcaaggactgcccgtttatctgggccttgatttatcaatgacaacagatttaacctccgtaggatatgtggccgtgcaagatggctttttctatgtcggtcaacattcctttatgcctgaagcccgagccaaagaaaaaatggcgacggataaagtgccatatgatttgtggagagagatgggatttatcacttatacgtctggcgaagcagttgactatcaattagtcgaacagtggatcattgaatttatccataaaaaccgttttcggccacaagagaccgcgtatgacaagtggaatgctcttcacttagctcagcggcttgaatcaaaaggacatacaatggtggaactgccgcagagaatcaatcatctgtcattacctacaaaaagcttccgagagaaggtgtatgaagggaaagttgtacatgggaatgatccggttttatcatgggcggttaataacgcaattatgaaaatggacccgcaagaaaatatcatgctggataaagcaaaatcaccgcagagaatcgaccctattgcggctgttataaatgcttacgctagagcgatgtatcacgacacaaaccatagagtagatttaaataatcacttcggctctggtaatttcagtttttaggatgtgagaaaatgaaaaaagccaggaaaaagatcaaagctttttttaagtgggattttcaccacaggtatatgaaagccctgctttcttttttctgcttgatattaaatgatctgctgtttatggcgggagccgcctttatcctgacagctgtctatagatggagcacaaacatcggtcttattctgacgggtgtctttttaatgttttatgcttacctcatatcaaagaaagcgaggtgatataaatgctgcttgaacgaatgtttgagaaacgttctggctcgtcagatcatgaagatggttttaacaacattttattaaacatgttcggcggccggaaaacagcaagcggcgaaagagtgagtgcaagcaactcacttgtgcagccggacatatttgcatgtgtcaatgtattgtcggatgacattgcaaaactgccgattcacacatataaaagaacggacggcggcatagagcggaaacccgagcacctgtccgcgcatgctgtttatgctcggccgaatccttacatgacagccttcacatggaaaaagcttatgatgactcatgttctgacttggggaaatgcatattcctatattcaattcggaccacatggttacccggaagcgctctttcccttgcgccctgattacacgaatgcttacgttcatccgacaacaggcatgctgtggtatcaaactgtgataaacggggaagccgttgaattatacgactacgaagtactacattttaaggggctttcgactgacggaatacatggtaaatcacctattggcgttgttcgggagcatatcggggcgcaagcggctgccacaaaatataacgccaaactgtacaagaacgaggcaactcctcgggggatattgaaagtcccggcgttcctggatgaaaaaccaaaagagaacgtgcgcaaagagtggaaacgggtgaatcaaggtgaaaatatcgccattatagataacggactggaatatcaatctatttctatgcctctgcaagaagctcaattcgttgagtctatgaagtttaacaaagcacagatttccatgatttataaagtaccgttgcataagctgaacgaattggataaagcaacgttttcaaatattgagcatcagtccattgaatatgtcagaaacacgctacagccatggattgtgaattttgaacaagaactaaacgttaaattgttcttagatcacgatcagaaaagcggccattacgtgaaattcaatatagacagcgagctgcgcggcgacagtaagacgcaggcagagtatttgaaaacactgcatgaaacaggagtgctgaataaagacgaaatcagagaattgcttgaacgcaaccctattgaaaatggcgacaagtatatttccagcttaaactatgtgttcctcgatttcgtggaagaatatcagcggcttaaagctggcggcgccatgaaggggggtgacaacaagaatgaaggataaagaggttcggcatttgacgacgccgattgagctgcgttccgaaggtgaggggcagagtgaatatatcgaagggtacgctctcaaattcgaaaaatggtcagaacgcttgggctggtttaaagagataatcagcagaacagctcttgactcagctgacatgtctaacgtcatcgcccttttcaatcataagcaggattttcccttagcgagaaataccgtttccgaggatactggccgtcttgaattagaaatagacgggataggcctcaaattccgatttaagccctcagacacgtcgtatgcgcgtgatttaataaagaatgtccggagcggtgtgatcaatcaatgctcttttgctttttcacttgattatggggatgctgaggcagatgaatggcgtatcaatgaagatgaggacatttacgagcgacgaatcaataaaatcaatcgcatttacgatatttcactcgtcactacgcctgcttacaacgatactgaggcggttgtgggtgcccgcagtttagaaaaggttgagcagctgaaagaaagacgtaattcatcagatgaagcgttaaaaatggaattggaactattaggccttgtactcccggagtaaggtcttttttagttcagaaaacaaggaggaaatgattttatggcaatgcaaatgagcaaaaaagaaatcgcattaagacaacagtttactgaaaagaagcagcaagcagacaaggcgctgcaggagggaaataccgatgaagcgcgtgcattgcttgatgaagtgaaacagcttaaaaatcaaatcgaattgatgaccgagggacgttcacttgatgttccggatttaccgggcggtgtaaactttgtgcccgagcaagagcgcaacccagaaggcagggccggcgatacaggggcaaaagaagagcgacaaaaaatgttcactcaagctttcatgaaatccctccgcggcaaacgcttaacggaggaagagcgcgatctgtttgaaagtgaagagtttcgtgcgatgtccggtaaaaatgaagaagacggcggcattctaattccggaagatatttcgagaacgatcaaggaattgaaacgggaacaagagcaacagcttgaacaatatgtaacggttgagccggttgcgacccgttcaggtacacgtatgcttgagaaaaacagtgacatgacgccgtttgcggtcttggaagaaatggacgaaattgcagagacagatcaaccgaagtttaccaagctttcttacaacattactgattatgcgggcatcctgccgttatcaaatactcttttgcaagatactgaccaggctattatgtcttatgtcgcaagatggtttgtgaagaaatcaatcacgacgcggaatgctttaattctttcaatccttgattctttgaaaaaggttcaattcaaaggcctggataatattaagaagacacttaacgtaactcttgatcctgctatctctgccggagctattatcatgacgaaccaagacggatttgattatcttgatcaactcaaagacggagatggaaagtatctattaaaagacattccaactgaaccaacaaacaaaatgctcttcggccgccgtgtcgtggttatttcgaataaagtcctcaagacagtctctggaaaagcgccaatgattattggtgacttgaaggaagctattgttttatttgaccgtcagcagcaatcaattgcctctactgatgtcggggccggtgcatttgagacaaatacaactaaagtgcgcgcaattgagcgtgaagacgtgaagttgtgggattctgaggctgtagtgtacggtcaattgacgttgtctgctgagtaataaaggagggctatcatgcgagtaactaaaaactacactgccgacgggggaaatcgtaccgtcatcggcggtgttttagaaattgccgggggcaaggttattaaagatggacaagaggtcagtttagacggcaaccaagctgaaccaggacccggaagcataaccaatgaaatgctggcggataagtcggtccgcagcaggaatatcggcaccggcagtgtaatggaagaacacttaaattcatctgttttagatcgtctcaaggctattgaagataaattgaaagagcttgccggttcccagtctgacgggaaaacggaataaaaataaaaggaaaaggatgattacagatggctgaagattatttatatgaaagtaatggagtcaaaacttcatctgaaaaaggaaaagacggcaaagcgataacgccagtctatctcaaagaaaacagcgaagaaaatcctctttttgtaaaaggattgcagggggaaaaaggcgaaccgggtccacaaggcgaaccgggcccacaaggtgaaccggctgttattgaagagggcagcattgtgcatgaaatgcttgcagaaaaatccgtccggagtaaaaacatcggaactggcagcgtgatgccggagcatttaaacagcgaagttacaaaagcgcttgatgaattgaaacaaaaaatgaataaacttgaaagtgacctggctgctttgaaaggaatagaagaagaaccgacagaataggcggtgtgtcctgaatggatttagaggctattaaaaattatttaaaggtcgagcatgaagaagatgatcgccagctcttgaatcaaatagcggcggccaaaagtcatatcatcaatggaataggccggtatatcgaagggcacccgcaatttgagctggtacttcaaatgcttgttgaacattggtatgaaaacaaagggatatatgagtctgggaaaaccggctcgtctatcccttttactgctgaaaatatattgacgcagctgcgttatgtatctgtggaggaactagaaaatgagaaaaaagatcagccaactccggcaccgtctgacctttcaaaagaaaaccgagacacaggatgaagaaggtaactggaatgcaacctatgtggacttattcacggtctggggagctgtggagggggctggttctcttgggaatagcgaatctatgattgccggagcattgggagtcaagacccctaaaaaaatcacggtgcgttaccggaaggatataaaaccgaatatgcggattgttaagcgcgttcctaaagataagacggaacgcgtttttgatattttggacactaacgatccagatgatcaagaggaagagcttgagattctttgtcaggaggtgggaatcaatggctgatatgagctttgatggtatagatgatctaacgcagtattttgaaaaaatcggcggagacattgaaaaggtggaacccgtagcgctaaaggccggcggtgaaattatcgctgaacggcaacgctcccacgttaaccggagtgataaaaaacaacctcatatgcaggacaacatcacagtctccaatgtcagagaatccaaggacggagtgaggtttgtggccgttggtccgaataaaaaggtagcgtatcgcgggaggttcttggagtggggaacctcaaaaatgccgccgcaaccgttcatagaaaaaggtggaaaagaaggggaggggcctgctgtggaattaatggagcgaatacttacagcgccgatcaaatgacctactctcctaaaattgaattggtgagcacacttaattccagtgccttattaaaaggcctggcatctggcggaattcataacctcgttgcgaatgatgtcagcgcatttccgagagtagttttttcggagattcaagatgctgatgcggattttgcagacaaccaagtctattcatttgaggtgcgttatcagatcagtattttcactcaagcgagcacccgcggcaaagaaacagcgattgctgccgaaatagacaggcttatgcgggaaatcggatacagccgatatgattctcaagatttatacgaaacagatacaaaggtctttcataaggccagacgttataaaaaaacctattatcaggagggaaagtagatggggaaagtattatccggcttggatatgtttcatatcgccgaagtattgaaagacacgaaagatgaattgaagttctctgatccgcaagaattaccgggtgccgttaacttgaaaattgatcctaaatccgaacaagaggttttttatgctgacaacgtggcatatgccactgttaatagcttaggtgatattgatggtgaaatggaagttgccgacctccctcttgacatgcagtcaaggattttcggtaagcaagtggagaatggcattcatttttctagtgctgatgataagacattggagattgctcttggtttccgggccaagctctctaccggcgggtacagatactattgggtgcttaaagggaccccagaattagtaccggttgaacacaaaacggacgaagggaaagctacgccccaaacagcgcaggtcaaaattaaattcatgcctcttactaatgtaaaagagggtaagcgcagatgggatgcaaaagcagaagaagataaggccaatgggattaacgcggaaacatggtttaaacaagttgtctataaggacatcacgaaagagggaacgcctgtcgttgatatcggtaaataattcattgagcgcctaagagcgctctttttatatgaaaaaggaggaacttacatggaagcattgtctattacacttcgacttgatggcaaagataaaaaatttgttacacctgaccacattacaggtttattgttccggaaggctgcaaagattgcagacgattttgaatcacaagattcagagcgtctttttactaatgaacaggttgaatttgtctgtaatacctttggccagaaatttacgcctgatgagtttgaaaaaggaattgatgcccggctggtaggaagaacaatctatgctgctgcacagtatgtgttggggaatattgccgaagcaacggctcttttaaatagcgaggggatttccaacggtgaagagccgggggagtaagtctatccgagtcagtccttgatatgtataacgcacttgaggaagtcggatatacacagaatcaaattgacgaaatggacattgtctatcatctgaaaagactggctcggagaaaatcacaagagaagacacaaacgaaggccaaaaacaatgacgaacctatgtatatcgatcaatttctcggataaggaggtgcccggttgagcaaagacataaaggtcagactgtattcgaattcatctgagtttaaaaaagaaatgagcgcttgtgctgttcaaatgaaaaatttgaagtcggaatttgaaaaaaaccgtacggcagtgggtgtgtggggaaacgaattaaaaactgctcaagtaaccgaaaaaacattaacacaacaattggaaacacataaacgcagagtaaaggctcttgagcgagcttatgcagacgcggctataaaaaaagggaaagacattaaagaaactcaaaccctcgcccgccgtttaaataacgctactgccgcaatgaataagacgcaaaacgcgctaaatagtacgactcagaggataaaagcgttagaggaggcagcgaaaagagcttcctcccgtgttcggatcatgggcgaacgaatggattcaattggcggaaaaatgcgttccgttggttcgtcagtagctatgacatcgggcatcgcctttggtgcgctggctctgtccctacgtgatgctgttcaggtcggcatggactttgaaaagcaaatgagtaaagtccaggccatttccggcggatcggcggcagagatcgcgaaattgagagaacaagcaaaagaactcggtgcaaccactgtcttcacagcaagtcaggcagcggatgcacagggttttttggcaatggccggatttaaggttaatgacatttatgacgcaatgcccgggatgctcagtctggcggcagctggccaactggaattaggcgcagccgcggatattacatcaaatatcatgtctgcctttgctctaaaagcaaaagagtcagggcacgcctcggatgtcattgcttacgccgcagccaacgcaaacaccaacgttgaacagatgggcgaagccatgaagtttttggcgccgaacgccaattctcttggttggggtatggaagaatcagcagccgccattatggcttttggtgacgcaggtcttcaaggttcaattgctgggcaggcttttggtacatccttgatccgtctcgcttcaccaaccggtaaggcttcgaaacttgtcaaaaaattaggttttgatttcttcgatgcggccggaaacatgaaaagtatgccggaagtcgttgaggaaatggaaaaaggtctgaaaggcatgaccaaagagcaacaggcggccgcattaaaaacgatcgtgggcgctgaagcatataaacattgggctgtccttcttcaaaaaggttcaaaggctctgggggataatactaaggcgcttgaaaaatcagatggagccgccaaaaagatggcggatacgatgctggacaatgcacacggaagcatagtagcttttcagtcagcacttgaaggggcaaaaatcaagctgacggaaagccttttgcctgccctgggcgatttagcaaacaagggcagcgacttgattatgatgtttaatgatctggattccggcaccgtgcaaaccatagcgaaaacagccgttctggcgacaggtgtattaggggttacgacagccgtcgccacgcttacagctggaataggggcgcttttagcgtttaccggccctgttggccttgcgattgtcggaggcacagcgttgcttggcggcatttcagttgctacttacgcttacactgaacaattgaagaaccagaaaaagcaacaagaagaggcgcgagaatccgccttgctttacggcgagggcgtttctaaagcaacacaaaaatctgcttccgcctatgtggatttaagggaaaaggcggaactacagctatttgaattgacccgggtatcgggttcagaagctgaaaaaatgtcatctgatatagttcaaacttattccaacatgcgggaccaactcatccaagaacttgaggggttaaagaaggatgctttagtcgtcttaaaagggatctatgctaataccagcgaaaaaaccaaaaaagctggcgaaaagatgactgataagatagttggctcaattgataaagataagcaagaggctagggataaacttaaacaattaagagagttagaaaaagaaactgggcttattttagctaatatgaatgcctctcagcgacaacgatttgatgaaattacctcttacttcgcaaaggccagcagtaaatttgcagccaatcaaaaagaggctttggctatgcaaaaggctgtaacagaacaacaaggggagctctcctttaaacaagctcaaaaatactacaatgatattaataaagtttataaagatggtgcaaaggcagcgcagaaagacatggagcacagcaaaactgtgattgaaaagttatttgcgcagggatatatggaggaacccgagcaaagaaaagctgcattagcagggatagtagccgcaaacaacgaggcaattgcacaaaatactgctcaatacgaaaagaacctaagctctcttttctctaaaatgtctagagatggaaaactgcttgattttgaaaccgggaaagcttttgagaagcagaaagaatttgttactaactctctgggaatggtgcaagaatttgatgaaaatgatgccaattggaaagaacgatgggcagcgcggcaaatagactttctgcaggaattaggaaacagcaaagagcaagcgatcgagaaggtgcaaaaaggtttggaagagtttaaccaaggaatagggttgtcagcagaagatgcacgtgaagaagccattcagatggttgctaaccttgaaaatgaattaaacaaacctacaaatgccgggcaatcaggaaagaaggttgctgaggacttttccgctggcttgaagcagtccacaccagcagttattggtgggggaacggtcttacagcaagcccttaacaattcgctttctgcagataacgccacgcccgcacaggccggacagaataaaggaaatgcctttcgtaccggtatcaattctacaaagcccggtaatgcacaggcaggatcgtctatacttcaatctgctttaaatgagatgaggaaaggcggcgggcaagcaaatgcagcaggacaaaacaaaggaaataagcataaagctggtttaacgtctaccgaaggtgccaatacatctgcggccggctctctcagctcgtcggtaacgaacaatttagccaaaacctcagacggcggaggcggtaaaaaggccggaactgaattggccagcggcgttctcagtaaaaaaggcacagcaaacagcgccggaaaaagtgttgcaaacagcgcaaaaacagggctgaaaagcgttaagacacaaagtgtcggttctgactttgtaaccggctttataaatggaatgggatcgcaaaacggctctctcttcagcgcggcatggaacttggggaaatccgccttgcggactttaaagaagtcaattgactctcattctccctccaaactaacaaaagcggaaggaaacaacttttctgatgggtttgcgttagggatagaggacaaagccaaaaacgtaaaacaaagcgctgcttttatggcgcagaacgcgatgacctcgtttaagcaggaattaaatcagatggctttcaacataaagggggctgctgatcagctcatttcaatgaagtcggagcttaccattcggaatgaagttgacacgcctgccttaaatcaaaagctcgatgctctaatcacactcctgtctcagcaacagtctggcggggcaggccaggccgcattacctcagcagcctattatcatccatccggctgcggtgcatatggacggccaacaaattgcgacgatcgcttttgaaaaaggagatggcaggatacttgatcagaaagctgcagaccgatacaaccagaatgcctataaaggcggtgtcagatcataatgctagatttatatattgattttaataacggtatgggggaacaaagtttaacaggcattctcccccgttttaaggtgcgcagcttcacgcctgactcaccgaatattgaacgagaaacaacgaccctcccaaggataaacggtttagtgctgccgcagcacccccgggacgttgtctacaaagagagagacatcaaggttgattttttattagattccatcattcccgaaaccttttatcagaacaggcatgaactttattcattgttagtgcagccgtttccttattatatttcgacggaccttctgcctaaccgtcggttccttgttacgtgtgacgggaattttactatcactaaggacaaacagaaaaatcatgccacatttacagtagggttcacggacattctggggcttgccgagtcgaaatatacctcttctaccatccagaatttcaatggggagcattggagtcccggcatgggaatccttcggagagatgatcttgaatatcatttcaagaaccaaaaacgattcagcgtttacaaccccggcggcggcgcggtcaacactctgcagcatgattataaggtctttctctgggccaaagggacaaacgtaaccattgcgaaccgaacgaacggggaaaaattaaaaattgagcaggagctaaaacgctcgcaaaaagtcacattcatcaggcagtacactgtaatcggggataagcgtctgaaaacatccggccgtctgccgacactggatgtaggatggaacgattttgaaattataaactcaaatgactttgaaattttatttgatactcgtttttattataagtaaggaggggtgacatggctgcggctgactttattaaaagtctggtaccaggagcgcagaaggtacggaaaaaatataacgtccttgccagtcttgtcattgctcaaggctgtctggaaagtgggttcggcacgagcggcctttccaaacaagcttacaatttgtttgggataaagggaacctataacggaaaatacgttttgatgtggaccagcgagcaggacaaatacggaaatgttgagagggtacaagctaaattcagaaagtacccttcatacgctgagagtttggccgatctgggaagcttatataatcgtcttgatcggtataaagcagtggtaggggaaacggattataaaaaagcatgccgggccgttcaaaaagctggctacgcaacagacatcaactatgctaataaattaattatcatgatcgaacagtataagttgatgcaatatgacgatacgtcagaattgccgaacgagcctgatgatccagaatccccggagaccccagaagaggaaccgagctttccgagtaaagaatatgcgggtaacgacatccctcttaataaaaaactgccgtcagatgtggactttcctcagctgcatgtttccacgaaagacggaaatgacgttgtggaagtaacaggcgtgatcgttgatcttacagacgatactaccgggaaaaagagctttacctttacgattaccaaaacagagagcaatgcgactgaattcgatttactgatcaacgacaatattctttacattgacgaaaggagattcaaacaacaaaaatactatattacagatgtagacttgaagcaggctaaaaacgtcctgacaaaaacaatcacggccaatcatatatttaccgttttgcttgctgagaatcgagtggatgatacagtaacgaagaaattgaccgtaaaagaggcctttgacattgcgttaaaaggtactgatttttcatatgtgctggaagagccacaaagcaaattcgccaccgccgaagaagagaattttggtgataaaaactctaccgaattaatagatcagctcataaatgattatgagttagagcttgacgtggataattataaaattcatgtctataagaaaatggggaaagagattcctttcacatttgactctcgttacaatatgccgggcatcagtatcaaaaccaactcgcaaaactgctctacccgtgcgtggggatatggtgcgatgtctaaagacagtaagagcacagacaaaaaaccgaaatacgtatttgagccgatcttgtacatccatccagaggaaaagaaattcctgcgggaaggtaaaccgaagtgggccgacccgatcagagacgaaactataaaaaagtcgggcagcatggtttctgcgctgaaaaaacatgtgaatccatatccggaaacagtcgtcagtgtggattatcaatatgtatacgaaccaaaattgcttaaaattgaaaagccgttctggaaaggcgatacagtccacattttagccgacacagcagacggaacgacttatgaggatgatgtgcggctcttaacgatccaatacaatccgctaaatccatacagcagcccgaagctgacttttgccaatttcagaaaagatatacaagatattgcggtgaatcaagcgaagaagctgagagaacaaaaacgatatattgatcaaatactgacagcgctttgataggcgttttttattttgtcgaaaaggagagtgaatacagtgttgaggttgaaaaaaaattatgataccactagaaactctcgttatgaggatgagctatctggtgatatggaagcgatcgagagtagcataaacggacttgaaagtgaaattacccgtcataagaaagctgctacagcacatacttctgagcaaattgatcacgggggcttttctttacgaacttatattgacggactctataaccgggtgcgtaatctcattcttaatgccgacgggacaaatgtaaaagaagtagtggatgcccgtgttactgctgatggggaaattgccccactgttgaaagagcgtcttgataaggaatataacaaacttctacgtaagatcaccagaaacgttaacgtagacgactacggggccgaccctaccggggagacagacagcacagaagcattcaaaagagcgatcggaaacggaaaggtgcggctcaatctatcagccggagaatacgtgatagggggcgtaaagctgccgtcatggacatatttgatcggccagggcatgggcgtcaccacgctaaaactgcacgaagacaccccggccagtgagtgggttgtcacaaatgctgatcatgcgaaaggcaaccggaatatcgttgtggaaggtatgtcgcttgactggaatcctgatcgtcagggcggagtaggcgcaacgggaggtgtacattcaagctgtcttcttttcgcacaagtaaagtttggtattgcgcgcggcgttgaaggcattaatcccggcttacattgtttcgatgtatcagcgccttcttataacatcacagcaaaagattacacggcaacggggagcaaatatatctggattgatcaatgtgtcggctcggggtatggtgacgacggcattacgacccattacagcgagtatattttcatcacaaacaatgtgatgacgaacccgcgcggaactgcacaccgtaaaggcggagccaattcaaacggaattgaagtggacgacggctccaagcatgtctgggttatagataattatacggaggggaatgtacggggcgtagaggtaaaagctcataaggaatggccggcaccgagtgacgttcacatccgcggccacgaatcttttcgtgacgttcgctcatttgatttacggcatattgatcaccatcttgtaaaagacccttggagcgagacggctcgtgatgtgacgttagtagattgcacatcccgggaacccgtctataattcgctttatgaaggattagctccgaaagcccttgtcgtttcggcgtaccagcgtgttcagattatcggattcaaagccataggtgatccaacatatgattacaaagacggctcgatcgttgctttccagtataagagtaggaagataacagtaaacaacttgcatataaccggatttaaaaaggctgattgtgacatctatattaccggcggcgatcagatgactgacgacgtgtttatttctgattttgttatccatgattccgcaagaaccggcatcgcgatagggggtggcgtgtataatgtcaacttgttaaatggccttatgcatgtggcaagcggaacggccggcattacatccccgaacacccagaccaatatttttcttgtcagagcttacggctataaagatgcggctgtccttgccggagaaaaacattcagtcgttccgaataacgtcaagggaggctttcgagcagcttccagctcaggacatgcacttacgaaatacagtgcgattattgcgtgtacagggccgacgtacgcgaaaggtgagcgcaacctgcttgcaggaaacgccggcggctcttcctcagaaggctcacgtaacagtgtcatgttttcatacgattctcatacaacaggagacgggccgtcctcgggtgtcatgttctcgaaggctaccaagaatagtaaatcttacacattggctttaggccatggaaacggcaaagcctcggaagccaacaaaaaaattgaattaaacgcaaagaatggaacagtcaaggctactggcgcaatagaaagtgtatcgaatttaaaagacttggcggagtattttgaatcagctgacggagcaaagatagaggcatcttatcttgtagcgttagagggggacaaaatccgaaaagcgcaagaaggcgacaagatactcggggtcgtttctaagactgccggcgttgtgcttggcggagctgccttctattggaatgatcgttttcttcgtgatgaatttggcggcattatctaccgggaagtatttgacggtgaggacatcattacgattccagctgagaacccgaactatgatccggaagctgagtacaagccacgagaggaacgagacgagtggcatattattggattgattggtcaagtgtttgtgcgcgttgatgataccgttaacgtcggtgacagtgtttcagcagttgacggcatcgcgacaaaggcggaaagcggcggatacggaactgtgatgagatttgaatccccgtacgatgcggaaaaaggatacggtgtggcgcaaatgatggttacaccgcagcactaaggagggataagcgacgatgtataaaacgggcagcgtgccgatcaacattaatacaaatccaatcaatggccggagtacaaatatacaatttatgacgcaagacacgggcagcgcaaagctgtttttttcttttacaaaggatggtgtaccgttgcctctgtcagccgtagatgcaaaaattgtcctactgtatggtgatggatcgttttataaaaagagcctcaccatcactgacaaggtaaacggcacagcggaatatgtgttgtccaatgcagaactcaagcattacggaacggttaaggcggaaatcaaactatattacacgaacggccaagcgctggcgacttcattttttactttctctatcgccaaaacgttagaggatcagaacatcgttccgacagctgattattacattgatgattttgaaacgctgagagacgggataaaccacatcgtcgaagaaatcagtcagactgtcgaggaattacagaagaaatttgccgatctggaagctattgaaacgaaagagggcgcgcagcagaaggcggatgatgcagaggaaaaggccagagcttatacggatgaacatgcgaatgacgaagaaaagcacattacagctgccgaaagaaaggcgtggaatgccaaggaaactccctccggcgcgcaaaagaaagtagacgcccatgcgaacgatcaagaaaagcatgtttcttcagcagatcggaaggcttgggacagtaaagaaacagaaagcggggcgcaagagaaggtaaatactcacgccaataatacggacattcatgttaccaaacctttcaaagatacattagaagaattatcaaagctgttcacagcgggttttaaagatgaactggaagaattattacgtcagttcacggcccataattacaaccaagaacgacatatttctaaagctgaacggaagacatggaacggagctgccacctatgccaacatcatgctgaagaatggagccgccgcagggacgcggacaccgatgtacgcaaagtggggggcgtttttaatcttacgggggcatgtgaaaacagacgccgaaattatattcggctccatccccgcggaatacgcacctgctggcggttccgttataacagtgccgttaagtggtacaggcggcacagccgatttgatcatttatgataatggggatttaaaaataaaatacccggacccggcggactcaagtaagatgggcggaggctactatctggatgtggtcgtcggctttcaggaaggagggacagcatgattcaggtttatgaatacgatgaaaatttcattttgactaaacccgttccggttgagcctgatgaagaagggaactacacaatccctgagaattgtacaaccgtccagcctccgtctttcataaaggcgatgtatcatcccgctgagaagacatggacggaggcggccacccaggaagaaaaaaaagccctggaaaagcaaattgaaagcgggcgggcaccttctcccgtcgatgaattgaaagctcaaaatgcggccattacaacgcagcttgcggaagcgcagagcttggccgaatcacaagtgcaaatgattgccaatctgtatctaatgctggcggagggagggaaaggggtatgatggattggtttacaagcgttaaaactatctacggatgggggccgcagtattacagtaatgcagacgtggcccgttttgttgaatgggggagaattacagaagatcaatacaaacaaataaccggcttaacctatccgatgacaaaacaacctgtcagtgtggatttaggcggcgccgcaaactgatcaacacccggagaggtgttttttattttgcctcgaaggaggtgataacaattggagggaatatacgtgtggatgaattttgagagcttacagatcgcaagagcatatctttttggggaggtgaaatatcttgatttaatgctggtgctgaacatcattgacatcattaccggtgtgataaaggcatggaaattcaaggagcttcggagccgtagcgcatggttcggctatgtgcgtaagatgctcagtttccttgtggttattgtggcgaatgctattgatacgattatggatctgaacggtgtccttacctttggaaccgttcttttttatattgcaaatgagggcctttccatcacagagaatttagcgcagatcggcgttaaaattccggccgccattactgaccggcttcatgtaattgaaagtgacaacgatcagaaaacagaaaaagacgatcaggcagcaggttaaaccggctgctttttttgaatccaaaaacagaatgggagagatttttatgtcagcatacagaaaccaatatattgatattaacaaatggacgcggccgggaatcaaaaacaacggcgtgaagaaactggtggtccattacacggcaaaccccggcgcgcccgctgccaatcattatagatactttggtcaaacgctccccgcacagaacagaaatctgtctgagaagaaacagacgtttgcctctgcacatatctttgtcgatcgtacagaggctatttgtatcattccgttgaatgaggtggcttatcatgcgaatgatgtccaacagattgttaacgggcagccttaccggggtgtcgcggcgctgaagccgaatgcgaatttcttatctatcggcgtggagctttgcattgaaaagaacggcactttccatccggataccattgcccgtgcagaacaagtctgcgctgagctatgcaagaagtttaaacttgatccgataaatgacatcgtgcggcactatgacattacacacaaaatctgtccggccccatgggtaagcagatcacaagggtttactgatttcaagaatggagtaaaagcgcgattaggtggggtagtaattaacaaaccaactaacaacaaatcaaaaaccaacaccgattcgaataaaggccgtttcatcaaaaacacggtggtttcaagtgatggccttgttctacgtacacaacggagcgcctcttcttccatggtgcttaacctgccgaatggtacggttgtaaaatatcagcttggatcaactgtcaacggatggggatatgttgaatacaccaattcaaaaggccagacattccacggatatgtgaatgtctcctatatcaaaagcgataacgaactgaaaagcggcggcaagaagaaggtaacagcctcaaagcctaaaaacactcagaaatcaaaattcagcctgcctgcgggtacttttaaagtcacaagcccattgacccgaggggaggccgtaaaacagattcagacagcgctggcggctcttcattattacccggataagagtgcaaagaatttcggtatcgacggcgcatatggcgcgaaaacagcaaacgcggtcaaacgattccaatctatgtacgggttaactgctgatggcatctacggtccgaagacaaaagcgaagatcgaagcgcttttgaaataatgaaaaatccccctctttatggagggggaaatatcttacgaaacgaccatgttaattatgatgtaagatactgctgaaatgacaaggaacgtgataagagctgcaattcccaactgtttaaatagtttggccttattgacagcttcttttccgtttttcttttctttattaattctcaaccatgttactaataaataaccaacaatgaaaataggcaaagtgtattttacataaaaatcccacatgatgatcactcctcgggtgttattatatgcaattattgcgggctgaaactaaaggccaaagcccaagttatgtctgctttcacccctttacccttattattggcatctgcccggttcgccattaacccaaagaaaacactagctgctccggggatagctcccggcacaaagccaaaataagcagtgaaaacagcaatacccgccgccgtgctgccggcagtattcatgtcatgtacaaagttatcagtagcgcagctattcattttaacatggtagccccaccagtaatgtttagggccgtagtttttgcctttacaagcaaggggcgccatttctggagattcagatatagtcttttcaactatacttaaatcctttttagcttctaatttacctgctgttatctcatcgtttaagtattcaaaataagccttttgtccatccagcaaacctttttcaataccatcagatttagccttttcatagtctaaagcaaaaagaccattcttcactgatacatacttttctaaggttaaaatatcttgtttgtcatattgttcttctgagtagcttttcacaggtgattgtttttctaaggcaaggacattcggagccaacgacatcaataaacacaaaaccaacaggacagacgcaaatttcttcatgaaattcctccttgtgttatatcttacaattaccaactaaaacatatataggcttggttgtaaccgaaattacaccgaacgaaaaccgcaaatacagcgcaaaataaaaagacctttccaaaaatgaaaggtcatttgaacaaatttctcatcattttatttgttgcttttcctacagcgcgacgggccatcctttttccgagcgtgccgtttttggtagcttgaacatcaccgagaatacgcgcgatcttatacaataaaccccttgttttgtttatgttcatatgtagctcctttttatccacccggtcttaattcacgcccaatacccattccaaccggcggatcgtatttcataccaattgcaggatcaaagcatatacctactggcgtatgatatttgaaattcattgcgctcaccccttttattacgtccgagttctctttgttcaattatacctgatagccgttttttcggtaacattttggtaacaaaaagataaaaaaatagttttatccaccgaaattaaaaacaacgaaaaaccttatttatcaacgtttatccacctttttaaaaatatacaaatgcagtataatagactcccaccgtctccatacataacagaggaaccgcagtgccgtcacatgacgcactgcggttttttcatgccgaaatcaaggagtgaaagtgaatggaaatcgtcatcatagacggaaaagatgttacaagcacagaagctttacaccgaatcttaaaagatcaattagatttcccggacttttatggtgaaaatctgaatgccttatgggattgtctgacaggctggatagaatatccgctgacattggtgtggaagaattttgaggccagtcaaaaggcattgggttcggatgctgatgatgtattaaggatattaaaaaaggctcaggcagaattagatggtgaatttttcattcaaatcgatcagccgtcagccgggacaacggacaggcactaaaaagtgcgtacttcctctcatctatttttctatccgataatagggacggacttctttattctaatgatgggttaatctataaaacaacagaccattataaaacatttcataaaataaaatagtggaaggtgttattgatgttaaaagtcatcatagacggaaaagatgttacaagcacagaagcattacaccgaatcttaaaagatcaattagatttcccggactattatggtgaaaatctgaatgccttatgggattgtctgacaggctggatcgaacttccgctgactttggtgtggaagaactttgaggccagtcaaaaggcattgggttcggatgcggaagatgtcttggagctgcttcaagaggctcaggaagagttagggaatcgatttgtcattcaaatcgatcagccgtcagccgggacaacggacaggcactaaaaagtgcgtacttccctcatctatttttctatccgataatagggacggaaggtttcaggctttcgatttctgtccatatataagaagagacttgcgatagggaggaatggatgatggatttgcagttgaaagggaagacggcgcttgtgacgggatctacgtcaggcatcgggaaggcgattgcggcttcgctgattgcagaaggtgcggccgtgatcattaacggccgccgtgaagaaaaggtgaacgaaacgatccgggaactagagaaacagacgccggatgcccgtctctatccggccgcatttgatttaggcacggcggaagggtgcggcgcgatttttcagcagtatccggatgtggatattctcgtcaacaatttaggaatctttgaacctgcggaatactttgatattcctgacgaagagtggctccggtttttcgaggtgaatatcatgagcggcgtgaggctgacacgccggtatgcaaagcggatgattgaacggaaggaagggcgggtgatttttatcgcgagtgaagcggccgtcatgccttctcaggaaatggcccattacagcgctacgaaaacgacgcagctgtcgctgtcacgcagtctggccgagctcacggaagggacgaatgtgacggtgaatacggtcatgcccggctccacgaaaacagagggcgtcgaaacaatgcttgagtcgctttatcccggtgaaaacctgacagtggctgaagcggagagacgatttatgaaggaaaatcgtccgacgtcgatcattcagcgattgatccgtccggaagaaatcgcccactttgtcgcctttttaagcagcccgctgtcgtctgccattaacggatctgcattgcggatcgacggcggcttggtgcggagcattatataagatgaacgtaaaaaaacccccgtaaagcgggggtttgtttaatgcggatcacgctgaaaccggccgatgatcctgctgattaaatcttttgtggcgcagtcaaaatgctcttctttttggtttgtcaacagcccgaccggcggtgaaattgttaagttattgatcggaatgaccttcgtgccctcgatcggttctgagtgcgccgtcgccgtaaagattgagacgccgatattttccctgacatagtattgatgagccatgctgctggtcagctccatttttcgatagcggctcccgatggcacgctgcaggtgctgttcaatttgaatccggatcgggcaattggcgggcgtgaaaatcaggcattcattttctaaatcctcgagattgacgcttgctttgtcggcaaggggatgtctgtctgacacgatgacattgagcgagtcatggaaaaacggatcgaaataattttccagaatcagctccggctcgccgcatacggcaaaatcaatggcgccctccagcagtttgcggctgcatgtattggcatcatccacgctgacattgaccgacatgtcaggataatcatgtaagaaaccccgcagtacggcagggaagatcaggcttgccgtcggttcggatatgccgatctgaataaggccggcctggccctgtctgatgtcggccaaagtatggtcaagcacctcgtattgcgcgagaagctgcccggcccgctcatgaaacagccgccccgcccttgtcagtttcagcttctttccccgttcaaacagctgcgcgcctacatcctgttccagctgtttaatccgcattgaaatcgtcggctgtgagtagttcagaatttcggcggccttataaaagctgcctgactgtacgatggtatgaaacgttttaatggtgcgtaattccaacgaaatcccctcccggctgttcattaattttcttgaacctttcctttactttttttgattagtcaaataaatcagtttgttttatagtataaacaatcaaagcttagtaaacaaattggaattatatatttttgcggggagagtgaccggaatgagtgaagacatatttcgattggctgagaaaaaggatgcgccggagtttttagagctgctgtacagcgcgtttcagccgatccgcaatttggagattgactggccgtcggcgcgggccgacatcgatatggtaacagaaaatattgaaaatcattcagccgtcgtgctcgaacgggacggacggcttctttcaacaattacgatccgttttccgtgggagagtgacacgcctccgtcaaaatatccgtttgtctggtggtttgcgacgcttcctgagctgaaggggcagggcatcggcagcaaacttttgacttatgtagaggaacacgtgctgcgggatacgctgaaggccccggccatcacgctcggcacttcggcgcgcaagcatccctggcttgtagatatgtacagacggagggggtatgaagtgtattttgagcaggagaaagacggagacatcggagtcatgatgagaaaggtgctcataccggagcggtttgacgcgtcgctgttaggcacaccgagctgggcgcaatgataaaaaaacggatcagagccggctgtctgcttctgctgctcggcgtgctggccgggtgcgggcaaggagaaagcacaaaagcggggagcggcgcgcagaccgtcattgtcggcacgggaactgattttccgaacattgcttttatggatgaaaaaggcgagctgaccggctatgacattgaagtgatgaaagccattgataaacagctgccgcaatacaaatttgtctttaagacgatggatttttcgaatctgctcacaagtctcggaaaccggaaaattgacgtgatcgcgcacaatatggcgaaaaataaggaacgggagaaacgctttttgtatcacaagatcccgtataactactcgccgatgtacatcacggtgaaggcggataatgacgcgatacacacgctccgggatttaaaagggaaaaccgtcatcgtcggcgcgacgtcaaacgcggcggactatatgacggcatacaacaaaacccacggcagcccgatacatttgaaatacgccgggcagggcggcaatgatacagcaaaccaaattgagacgggacgcgctgacgccaccgtatccacgccgtttgccgtcgattttcaaaataagacgcacgcgttcaaacaaaaaacggtcggtgatgtgctgctggataccgaggtgtattttatgttcaataaaaacagccaaaccctggcggacgatacggatcgggcgattcaaaagcttgagaaggacggcacattgaaaaggctgagtgaaaaatggctcggcgcggattattcaaaatcaagtttcacgaaataattgaagcagaaaacggggcgatcacatgaaaataagattggcggtcatgtcattaacaattgccgcaacggcggcgttatcagcctgcggcgcgggcggggaggcggcatcaggcaatcagaaaaacgtgaacaacatcacggtcggcacgggaactcaatttccgaatatttgctttattgatgataagggcaaattgacgggctacgacgttgagctggtgaaagagcttgacaggcgcctgccggactatcgtttcacttttaaaacgatggatttctccaacctgcttgtcagcctcggccagcataaagtcgatatcgtagcccatcaaatggagaaaagcgccgaacgggagaaaaaatttctgttcaatcaagtcgcgtataacaacttcccgctgaaaatcacggtgcttcaagaaaacgggaacattcacggcattgatgacttgaaagggaagcgggtcattacgagtccgacgtcaaacggcgcgcttgtgctgaagaaatggaatgaagaacacgacagtccgtttgaaatcgcttatgccggccaaggctccaacgatgcggccaatcagctgaaatccggccgcgccgatgcgacgatttcaacgccgtttgccgtcgatttccaaaacaaaacgagcgcgatcaaagaaaaaacagtcggcggggtgctgtcaaatgccaaagtgttctttatgtttaacaaaaatgaacaaacgctgagcgatgacattgataaagccctgcaggaaatcattgatgacggcacgcttaaaaagctgagtgaaaagtggctcggcgcggattattcaaaggagcaatattaagtgaaaaagagagggatcggcaatggaaaaagcgtttgatatcagtatgatcgcgtcctttgtgccgacattgctcgggtatttgcccgtcacgctgtatatattggcggtgtctttgctgttcggctttctattggggctgcttttggcgctgccccgcatctatcgcattcccgtcttgaatcagtttgcgaagctgtatatctcttttttcagaggaacgcctatcatggtgcagctgttcattgtattttacggcattccggcgctcacggcgctcgccgggattgatacctccaaaatggaccctttgtatgcggccatcgccacgtatgcgctgagcagcgcggcaagagcggcggaaatcatcaggggaggtgtgaacagcgtcgaccgcgggcaggcggaggcggcgttcagcatcgggctgaacggggggcagacattccggcgcatcattctgccgcaggcgcttgtgcaggcctttcccaacatcggaaatatggtgatcggtttcttaaaagatacatcactcgctttttcgatcggggtgatggatatgtcgggcagaggacagaccttgattacatcgagcaatcattctttagaagtgtatatctcgctttctgttctgtattatgcggccgcccttttatttgaacgtgtcttcagatgggccgaaaaacgaatcaagaaagatgagacgcgccttgtgacggtttttgacatgagcgcgcacggctgaaaaggagggagaacagtggagctggacattccgtttatcggcactgcgataaaacaaatgatgaaaaccgttccgcttacattggcgatgacggtcattccgattattgccggatttttcatagctctcggcaatatcacggtgcgtatattccgcatcaaatggctgctggcctgctcatcgttttacgtgtcttttttccgcagcaccccggcgattctccatattatgctgatttatttaggggttccgctgattgccgatcaattcagccgcgcgtttcatctcggctggtcggccaatcagattccggtcgccgtgtttgtcatcatggcactgtcattaacggcaggcgcttatatgacggaaattctccgatccgggatcatggccgtcgatacggggcaggcggaggcggcatattcaatcggcctgacgcggggacagatgattcggcgcgtggttctgccgcaggcgttcgtgatatcgctgccgaacttcaccaatataggcatcggctttttgcataccacttccatcgcggcaattgttgcagtgcctgaaattacaggaacggcgacgattgcggcatccgataactatgcgtttctggaagcatttatcggggcggccgtgatttattggggattaacgctgattctcgaagctgtaaacagtctggcggaaaaaagagcggccagatatcaaggaggcgcattatgatcgaaatccgaaacattcagaaacattttggcagtcatcacgtgctaaaggggatcaatttaagtgtccggaaaggagaagtcgtgaccatcatcggcccgagcggttccgggaaaaccacttttctgcgctgccttaatttacttgagcggccggatgagggcgccatttcgctgcacggtgaagtcattaactgcaaaaagcctgccaaaaaagacattctcagactgaggaaacagacggcgatggtttttcagcaatatcatttgttttcgcataaaacggcgattcaaaatgtcatggaaggcctgacggtcgcaaggaaaatgaaaaaaacagatgcgtacgccattgccgagcgggaactggccaaggtggggcttcaggataaattgcacgcctatccgaatcagctatcgggaggacagaagcagcgggtcggaattgcccgggcgcttgccattcatcctgatgtgatgctgtttgacgaaccgaccgcagcccttgatccggagcttgtcggcgaggtgctcgatgtgatgcttaacattgtgcggaccggcgccaccatgatcattgtcacacatgaaatggaattcgccagaagagtgtccgaccaaattgtgtttatggatgaaggagcaatcgtggaacaaggaacgcctgaggaagtcttttacaagacgaaaaaagaaagaacgaagaagttcctccgccgcgtgctgcctgattacggttatgacataaaagagcgcataaaggagcctgtcgtatgattcgtttaagcattttagaccaaagtgtcaccgcggaaaaccaaaccgcagaagaagccttgcggcaaacggtgaaattggctcaggaggccgaacaatacggatatgaccgtttctgggcggcggagcatcataacaatgaagagatagcaggatcagctccggaaattgttctggggtatcttgccgcaagcacgaaaaaaatccgtctcgcatccggcggggtgatgctgcagcattacagtccttataaagtggcggagcagttccgggttctgtccgcccttgctcccggccgtgtggcgctcggtgtcggcaaagcgcccggcggatttcagctgtcaaccgatgcgctgcagcgggagcttattcagcccgcccgtttatttgaagaaaagcttgaggagctgactcatttcatccgaaatgattttccggactcgcaccgctacgcgtcattgcggccggcgccgcatactgagtatgcgcctgacatctttttgctcggcggcagcacggaaagcgcgatatccgcggccaaactcggcatttccttcgttttcgcctatttcataaacggtgaagaggctgcgttagaaaaagcgcgccacgcctttgacgagcatctgccgaaagggtcgaaggcggaatttcaccttgcgccgatggtatttaccgcgcatacaaaagcagaagcggaaaaacacatggtatcgcgtgagtcggtcaaaatcattctcgaagacggcaaaaagatgaatgtcggttcccgggaacaagcggcagcgtttcttgaacaagtcacgcagccatataagctgattacacaaaagacgggtgtgattgccgggacaaaagaagagaccgccgccgagctgcgacgattatccgttcaatacagcattactgattttgtgattttgtcgcctatcaaaaacgctgaggaaaaacgattgtcttaccggctgttaagcgaagcggtgcagccggccccacaattataggagggatgaacatgagtcatgaagtaaacgtagtggtctggagcaaacagggctgctcctattgcgatgaagtgaaaggatatttgcgggaaaaagccgttgcatacgaaacaattgatgtgacagagcgggatgaattacgtgacgtgctgcaggcgaagtacggcatccgtcatgtccccgtcgttgaaatcggcagcggtgacagtcgtgtgtatcaggccgttactcaagtcggcattgaacatgtagaacgggcgcttgccgattacgaggggaaaaagggggagagaaaatgaaccggacggatcttattcaattcggagccatgattcacggtgtcggcggcacaacggacggctggcgtcatcccgacgccgatccgacagcaagcacgaatgcggcgttttacaggcaaaaagcgcagactgctgaaagagggctgttcagctttgcttttattgcggacggcttgttcatttctgaaaagtccatcccgcacttcttaaatcggtttgagccgatcactattttatcggcgcttaccgcatctacaacccatcttggtttaatcggcacattttccacatcgttcactgagccgttcaccatcgcaagacagctgatgtctcttgaccatatcagcggcggccgggcgggctggaatctcgtcacctctccgcaggcgggagccgcgcgcaatcacagcaaagaaagccttcccgaccacagccggcgctatgccatcgcccaggaacatgtggacgtggtgcgcggcctgtggaattcctgggaagaagatgccttcgtccgcaacaaagaaaccgggcagttttttgacccttacaaactgcatcgcctgtatcataaaggcgagtattttcaagtggagggcccgctgaatatcggccggtccaaacagggagagccggttgttttccaagcggggtcttcagaaaccggacggtcgtttgccgcgaggaatgcagatgcagtctttacgcactccaattcacttgaggaaacgaaagctttttatgatgatgtgaagaagcgggcggcagattacggccgggacgcttccaagctgcggatctttccgggaatcagtccgattatagccggctcacaagaagaagcggaagcgaaataccaagaattcgccgagctgattccgatagagaacgctgttaaatatgtggccagattctttgacgattatgatctgagccgttttccgctggatgagccgtttcctgatttgggcgacgtcgggaaaaacgcgtttcaaagcacgacagaccgtatcaaaagagaggcgaaagcccggaatcttacgctgcgtcaagtggcgcgcgaagccgcgtttccgcgaacccattttatcggcacaccggaacgtgtggcatcattaattgaaacatggtttcagcgggaagcggcggacggatttattattcattctgacattccgggcatgcttgaagcctttgtggatcaagtcataccgatccttcaggaaaaggggctgtaccgaaaaagctatccggccgatacactgcgggggaatctcggattggatattccggcctgcagacccaatccgattttgagcagaaactgaggtttctgctttttctgctgcttgccattcccgtcattacagccttttcaaaaaaatatactgatttcgagatattattgttgctaaatgatttttttgtaactataattattacagaactgatcagtataaaaaaacattcatatttcataataaatgtgtgtgtaatctgaaaacgaaagggctgtttataatggcaaaagtactttatatcactgctcatcctcatgatgaaaagacatcttacagcatggcgacaggaaaagcgtttatcgattcttataaagaatcaaacccgaatgatgaggttgtacatatcgacctttacaaagagaacattcctcatatcgacgcggatgtattcagcggctggggaaaacttcaatccggcacaggttttgaagagctttctgaaaacgaaaaagcgaaagtcggccgtctgaacgagctgagcgatcaattcgcgtcagctgacaaatacgtattcgtcacaccgctttggaacttctcattcccgcctgttatgaaagcgtaccttgattctgtggctgtagccggaaaatcattcaaatatacagagcaaggcccgatcggtctgttgactgacaaaaaagcgctccacattcaggcgcgcggaggctattactctgaaggcccggcggctgacatggaaatgggccaccgttacatcggcatcatgatgaacttcttcggcgttccttcttttgacggtttaatcgttgaaggccataatgctgaaccgaataaagcacagcaaattaaagaagatgcgattgcccgcgcgaaagaagccggaaaatcattctgatcttaaaaaaaacctccccgccgtcggcagggaggttttttatattaaagggcaatcgtccgtttttgctcgctgcttttcatcgccgcttcaatgacacggatgacatcgatgccttcttttgccgtaacgggaagcggttttccgtttaagatgctgtccgccagcagtttgtagtacgtaaggtaagagccgttctcagaggggattgtttctgtatgccttttttcatccgctgcggttgtcagctctccgaagttgtcaggatcatcggcgccccagctctcgtcaaccggctttttgcccgctgaaagcgcatcttcctgtccatccattccgtatttgataaagcttgcattccgtccgtgaatctgatagcgcgggccgcttgccgcattcatggagccggattgaaggatgacctgaagcttgccgtaatggagcgcggccagaaaattatcaacggtttcgctgttgtcccgctgcttcatcacatgtgcggtgacggattccggcattccgaaaagcagaagtgtctggtcaataatatgtgaaccgagatcatacagcgttcccgtggcgggtccgttcttttcgcgccatttttcctgtacaaccgggttgtatagatcgtagctgacttgatatgtatgaatgtcttgaagcgccccgtcccgaatcagcttttgtatcgttaaaaagtcattgtcccaccgccggttgtggtacacgctcagtaagacgcctttatcttcagccgttcttctcagttcctccgcttctgctgaagtcgccgtcatcggtttttccacgacggtgtgttttcccgccagtagacatttcatcgctgattcataatgcattccgctcggtgtcgtgacgatgacgaggtcaatgtcaggatcaccggtaatgtcttcaatcgcgcgcacggcttcagcccccggcagatcacgtttgacctcctccgttctggacgtcatgacttttttgatctgataatcatcaaggacgtccaaaagcggcgcatgaaagactttacccgacaaaccatatcccaatatgccaacctgtatcgttttcaatgaatttccccctcttgatatgtgataacaatatataccccgcgggtgtactggtaaaacttgtgtgttgaaaattttttacaccggattttcaagtctgtataatgaagataacgaagaaaaaaaccgaggtggaaaatggacaaacataccgagcatcaatcgttaaatcataaaagcgccaaagaaaaagaccagatcctgaaccggctgaaacggattgaaggccaggtcaggggcattcagaatatggtggagaacgaacgatactgcgtggatattctcgtgcagatctcagccgtacaggcagccatgcagaaagtcgcgtttcatctgctggaagatcacgcccatcactgcgtagccggcgccattgagagcggaaacggggagcaggcgattgccgagctgcttgacgttgtgaaaaaaatcgcaaaatcgtaaaataaaatgttttgaaataccctacaggggtatggtaacatgaagaagaaaaaacaagacgtggagggaatcatcatggaacaaaaaacactgcaagtcgaaggcatgtcctgtcagcactgcgtcaaagcagtagagaccggagtaggagaactgaacggagtgacggcggttcaggtgaaattggaagccggacaggtggatgtgacgtttgatgagaacaaagtctccgtattagatataaaagacgcgattgaagatcaaggttatgacgtcgtataggatttatcgcgctgcggaaacgggcgcggttttcttttatcatatttatacccccctggggtttatgaagagagatgaggacattgagtgaaccgaaagaaatgaccattcaagtggggggcatgacatgcgccgcctgcgcttcaagaattgaaaaagggctgaaacggatggacggcgtcaatgacgcttccgtcaatcttgcgcttgagacttcaaacatttcctatcaccctgacaaaatcgaagcaagcgccataaaagaaaaaattgaaaaactcggctatcacgtcgtgacggaaaaagccgagtttcagattgaaggcatgacatgcgccgcttgcgccaaccggattgaaaagcgcctgaacaaaatagggggagttgacagcgcaccggtgaatttcgcactggaaacagtcaccgttgaatacaatccgaaagaggtgacaccgaaagagctgaaagagaccgtggcaaaactcggctacagattagacgagaagaaagcggttgatggagacggcggattatcccaaaaggagaaagagcagcgaaaacagctgatcaggctgatattttctgccgttctctcctttccgcttctatggtcgatggtcagccatttttcttttacttcttttatctggatgccggatatcctgatgaatccgtggctgcaattcgcgcttgccaccccggtgcagctcgtcatcggttggcctttttatatgggggcgtacaaggcgctgagaaacaaaagcgccaatatggatgttctcgttgcgctcggaacgacggccgcttacgcatacagcctgtacatgacgattgcgtctctcggacgagacggacatgttgaggggctttattatgaaacgagcgccattttgctgactttgattttgcttggaaagcttttagagatgaaagcgaaaggccgctcatcagaagcgattaaaaagttaatgaagcttcaggcgaagacggcggcggttgagcgggacggcaaagtacaggtgattccgattgatgaggtccggacgggggacatcgtatacgtgaaaccgggagaacgcgtccctgtcgatggcgaagtgattgaaggccattccgcaattgatgaatcgatgattacgggagagagcatgcctgtcgataagtctcccgaaagcagtgtcaccggtgcgacgatcaatgcaaacggctttctcaaaatcagagcggtgaatgtcgggaaagataccgcgcttgcacacattattaaaatcgtggaagaagcccaaggatcaaaagcccccattcagcggctcgcggatcacatttcaggcattttcgtcccgattgtgctggggctggccgtgctgacttttctcatttggtatgtatgggccgcgccgggacagttttctgaagcgatcggcaaattcatcgccgtgcttgtcattgcctgtccgtgcgcacttgggctcgccacaccgacgagcattatggcgggctcgggccgcgcagctgaattcggcattctttttaaaggcggagagcatttagaaaaaacacagcgtctgacgacaatcgtactggataaaacaggaacggtgacaaacggcagaccggttctgacagacgccgtgccggcagcgggaatgaacgaagaggaactcctgcggctggcggcggccgccgaaacgggatcagagcacccgcttggagaagccatcgtgtcaggagccgaaaaacgggggattgccatcccgaaaatcacccggttccaagcccggatcggttccggaatctatgcagaggctgacggcagaacgattctagccggatcaagacggctgatggaatcagaacacattgaacatgaggcgctgcttccgcaaatggcccgcttggaggcggaaggaaaaacggtgatgcttattgcggcagacggcaaagcggcggggcttatcgcagtcgccgatacaatcaaagaaacatctccggccgcggtgaaacgcctgaatgatatggggcttgacgtcatcatgatgaccggtgacaacaaaaagaccgcagaagccattgcaaaagccgcgggcatcggcagcgtgatcgccgaagtgcttcccgaacaaaaggcggcggaaatttcccggctgcaaaaagaaggccggcgcgtggcgatggtcggtgacggcatcaatgatgctccggcgctggctgtggccgatatcggaatggccatcggcaccggcacagatatcgcaatggaagcggcggatattacgctgatccgcggtgacctgaacggcattgccgacgccatcggcatgagcaggctgaccatgagaaacatcaagcagaatttaggctgggcattgggatacaacagcatcggcattccgattgcggcatccggctttctggccccgtgggtggcaggcgctgccatggcgttcagctcagtatcggtcgtgcttaatgctttgcgtttacagaaggtgaaaaaagacaaaatgggctgatgcctgttttgtcttttttattgacactttattcaaagcctgcatataatagagaaaacacatatatgagtatatgttcatatatataaattcgtttagctgtattgatgttatgggaatcctattacggaaagtagggtgagtcgaaaatgaaagcagccaaaggtgaatttgttttagacggacttgattgcagcaactgtgcaaaaaaaatagaaaacggcgtaaaagccattgacggcatagacggctgtgctgtcaattttgcggcaagcaccatcacggtctcagccggcggcaaaaacgagcaatggatgaaagacgaagtcgcgaaaaaagtaaagtccattgatcctcatgtgaccgtccgtgcgaaacatgaagataaacccggcgaggatgaataccgcaaaaagctgcacctgatgttagtgaggctggcagcgggagccgttttggccgtcatcgcttacttcgcgcacacgggcgccgtccttgagtttctgctcttttttgcttcatatttgatcatcggcggcgatatcgtagccagagcgggaaaaaacattgtccgcggccaggtatttgatgagcattttctgatggcgcttgccacgatcggcgcatttgtgattcatcagtatccggaaggcgtcgcggtcatgctgttctaccaaatcggtgaattgtttcagggagcggccgtcagccgatccagaaaatcgatcagcgcgttattggacatccgtcctgagtacgccaatgtgaaaacggaaaacggcatggctgccgttccgccgcaggacgtcaaagtcggacaggtcatcgtcgtgaatcccggagaacggattccgctggacggaaaggtgctgagcggttcttcgatggttgatacatccgctttaacgggcgaatccgtgccgagaaaagcggagccggggcaagatgtgatggccggatttatgaatcagaacggcgtgcttcatattgaaacctctaaaggatatgaagactctgccgtgtcaaaaatattggatctggtcgaaaatgcggccggacgtaaagcgaaaacggaaaactttattacgaagtttgccaagtattatacaccggccgttgtcattgttgcggtgcttctcgcctttttaccgccgcttctcgtgccttcagcggcgctatccgactgggtgtaccgcgcgctgattttccttgtgatttcttgtccgtgcgcactcgtcgtctccattccgctcgggtttttcggcggtatcggggctgcgtctaaagcaggggtgctcgtgaaaggcagcaactatttagaagcgctcaatcaggtggcatacgccgtgtttgataaaacgggaaccttaacgaaaggcaatttcgccgttactgatatcaaaccggcggcaggatttacgcaagacagcctgcttcatgcggctgcgcttgccgaagtccattccaatcatccgattgcttcatccatccgtgaggcttacaatcaaccgctcgcggctgaggagattgaagaatatgaagaaatacccggacacggcattcgggtgaaaaccggcggatcaacgattttggccggaaatcaaaaactgatggcaaaagaacaaatcgcttccggcacagctgaaaacaacggaaccgtcgtctatgtcgccgttgatcagcggtatgcgggggcgatcgtgatcgccgatgaaatcaaagaggacgccaaacaggccattgcccgtttaaaagcgctcggcgtcaaacggacagtgatgctgacgggtgattcaaagcagaccggtgaagcggtcggccgcgagctcggtattgatgacgtgtatacagaactgctgccgggagacaaagtagaccgagtcgaagaactcgaagcggcgcttgcaccgaatgaaaaactgatgtttgtcggtgatgggattaacgatacgcctgtgcttgccagagctgacatcggagctgccatgggggctctcggttctgatgccgccgtcgaagcggccgatgtcgtcctgatgacagaccagccgtcaaaagcagccgaagccatccggattgcacgccgcacacgccggatcgtctggcagaatatcggatttgctttaggcgtaaaaatcatttttctcctgcttggcgcattcggattcgccaccatgtgggaagcggtcttttcagatgtaggcgtcacgctgatcgccgttgccaacgcgatgcgcgtcatgagagtgaaagcggaataattgtcaaagataattcgtttttcagggttttcttaaacaaggttgtcttggtaaaatagagaagcgggccatccggcatccgcttcttttttattttaaaaacaatgaggtgtctgagtgaaaaagaaacaatcgtctgcgaaatttgcggtgattctgacgttaatcgttgtcgttttatttgcggccatcgtaattattaacaaccaaacggaaaaagcgggcgaaacagtcgccgaacagccttccattaaaggacagcccgtgctcggcaaagacagcgcgcctgtgacggtagttgaattcggagattacaaatgtccgtcatgcaaagtatttaacagcgatatctttccgaaaatcaaaaaagattttatcgataaaggcgacgtgaaattttcatttgtgaacgtcatgttccacggaaccggctcgcgtctggcggcacttgcttcagaagaggtgtggaaagaagacccggcatcattctgggctttccatgaaaagctgtttgaacagcagccgtcaagcgaacaggaatgggtcacgcctgcattgcttgaaaaaacggtcaaaagcaccgcgaaaaaggttgatcctgacaagctgaaggaaaaccttgataaagaaacctttgcaaaagagctgaaagctgacactgacctgaatgataaattaaacattacggcgacaccgacgatttatgtaaatgacaaggtgattaatgacttctctaaatatgatgagatttcaaaaacgattaagaaagagctgaaaaatgaaaaatagaatcgtgtttttatatgcttcttgggtgatagctcttgctgccatgctcgtcagcctttatttcagcgagatcagaaaattcataccgtgcgagctgtgctggtatcaaagaattctcatgtacccgcttgtcctgattttaggaatcgccaccttccagggtgacacgcgcgtgaaaaaatatgtgctgccgatggccgtcatcggcgcatttatatcgaccatgcattaccttgagcagaaggtgcccggtttcagcggcatcaagccgtgtgtctacggcgtgccttgctcatctgaatatattaactggttcggtttcattaccattcctttcttggcattgacggcatttattctcattattatctgcatgtgttttgtcaaaacggaacgcacggcaaaataaagagcctgctccatgggagcggctctttttctattatttgtaccaagctttatttgtcgcaatctgtctgttatgggagctgtcccaaatatccacggaataggcataatcataattcatgacgcagcggatgccgctgccttgggcgtcatgctgaagtccgaagttatgggaaaactcgtgctgtgccgctttcgccgtgttggccgttccttgatcaaggttcacgctgaaagccgggccgctcggtttgccgttatatacatacgcgataccgccggcgtcaaaacttgattttgcggtaaaaccgacgacaaaatgataattttgatttctgaagctgccttggagattcgataaaatctgagaactgtttgagccggaggaattccaagcctgcacggcctgtacgacgaaatcaatgttgtgatcacggttaaaagcgacatccgcctgctccacgatctggacgattcgcgtttgccagtcgctgtatttggcgcggtattcagcgtccgccaccgccagcactctgaccttctggctgcccgtaccggctttagttgaggctttatcctgactgacattggcattaaatcgtttcgtgccgacctgcttgccgttttcatccagaatttttgtgtcaaccgtctgttcaacttggaccgggcccttcaggtctttaaaatgatcggctttcggaagcgggtccgtatacaccgttttcgccggctccgcatgagtgtgcgaatgtgtatggctttcggctgacggcaggccgggaattaatccggcggccaataaaacaggaaaaacaagtgaactgattttcatctcataaccccctttttgttagagaaagtattcaatgaaacttctaataaaccttccattaaagtataaaataggaaaatactctcgctctcagccgttgcgggtgaggttgtcccggattaggaatcagaatctttcaaaaataaggttgattttaagagaaagcgattataaaatctaatggtcgtcagaaaatttaacaaataaaaaggagcatatggaatggcctgggagctgcttagtgtaatcggcatcattgcgtttgcggtcagcggagcgattgttgcgatggaagaggagtatgatattttaggcgtgtatattttggggattgtaacggcgttcggcggaggagcgatccgaaatctgctgatcggtgttccggtctccgccttgtgggagcaaggcgcgttttttcaaatcgctctcgcatcagttacgattgtctttttgtttccgaagctgctgttaaggcattggagtaaatggggcaacctatccgatgccatcgggctttcggcgtttgccatccaaggcgctttatatgccgtgaaaatgggccatccgctcagtgcggtgattgcggcagcggtcctgaccggcagcgggggcggcatcatacgggatcttcttgccggacgaaagccgcttgtgctgaaagcggaaatttacgcggtctgggccgcgctcggagggttaatcgtgggcctcggctgggccggggatgccgccggtttgtatgtgctgtttcttgtgcttgtggcatgccgcatctgcagttatgtgttcaggtggcgcctgccgaatcgttcctatcatatagatcagtaaaaaaaccgatttcacaaacgaaatcggtttttttcataacggcttctgataaaaaaagacgcccgatatgataagaaaaagggtatttgaccataatgctgaataatatgttgcatatatgtttgtatgatgaaagccggatttgtcagcttgatgtcggaggtgccgctgatggcaaaacgtgataaagagtggaaagaagagcaggaaagaatcaattttgtcatgaaggaactggaacagaaacaaactcatcttgaagcctcatcgggcggattgaagcaggatattgtgggcttgagaaaaacgttttgggatgatgtcaccgtgaatatggatgatgcccacgaagcggctgagacattttcaagcattaaacagcaggcagaaatgctttctgaacgtgaacggactcatcggcttcaatatcggcagcttcaaaaaatccaaaagctgaaaacctctccttacttcggccgtgtcgattttacggaaaaaggggagtcctcttccgagcggatttatatcgggctgacttctttgatggatgaaaacaacgagcaatttctcatttacgattggcgcgcgcccatctcatctctttactatcaatattccccgggaaaagcccgctatgaagttccggaagaaacgatagagggagacatcacactgaagcggcagtttatcattaaaaacgggacgcttaaagcgatgtttaacacagatatgacgattggtgacgaaatgctgcaagaggtgctgagcggccattccggacagcatatgaaaaacatcgtgtcaaccatccaaaaagaacagaacgaaatcatccgggatgaaaaaagcaaatatctcattgttcagggagccgccggaagcgggaaaacatccgcggcgcttcagcgggccgcttacttgctgtaccgcgggcgcggggtgcttgatgcccgtcagattgtattgttttccccgaacattttgttcaacagttatgtgtccgccgtattgccggaattgggagaagagaatatggagcaggccacctttcaagaatatatcatccgccggcttggacgaaagtttgattgtgaaagcccgtacgagcagcttgaatattgcctgactgaacaaaaccaggacgcactttccgtaaggctcgcagccattgcttacaaagcgtcatcagctttccaggccatgattgaccgctatgccggctcgctttccggctcgggcctgatgtgtaaacagatcagcttccggggagacatcctgatttcaaaagagcggattgaagactatttttattcacttgatcagcagctgccgattccgaacagagctgaactgacggcggaatggcttctcgcggaaatcagcgctctcgaaaaaaaggagcgtaagaaggaatgggtcttgcaggagagcgagctgcttgataaggaagactatgctgaggtttatcaaacactcaagaagcaggcggcagatgatgaacctgtatttgacgaccatcagcgcgaacagcggctgcttggcgccattattgtcggcaaagcctttaaaccgattaagcaggccgtcagacggctcggctttctcgatataaaacggatgtatctccggctgttttcagactggggagctgatgaaaagcccgatcattgggagagcatcggcgctttgaccagaaacgcatttgcagaacggtcacttccgtatgaagatgccgctccgtatctgtatttgcaggatctgttagaaggaaaaagaaaaaacacacaaatgaagcacgtcttcattgatgaagcgcaggattattccccatttcagctcacgtatattcaaagcatcttcccagcggcaaagatgacggtgctcggtgatgtcagccagtcgatttatgcccacaccattacgggcccttcttccctcgccggctgctttcgcaatggtgcagaaaagtatgtcagcctgaagcggacttacagatcgacgcggcagattgttgaatttacgaaagcgctgctggctgacggcgatgatattgagccttttaaccggaacggggaaaaacctcgtgttttgcggacggatacagaaaatgcgcggcgggaacaattggcggatacaatccgggagctcagacaaaaaggctgggagacggtcgccgtcatctgcaaaacggccgcggaagccaaaaaagtgtttcaggcggtcagcgacgggagcggtgtccgcttgatcaataaagaaaaccagccttttcaaaaaggggtatgcgtcattcccgtgtatttggcaaaaggcattgagtttgacgccgtcattgccgctgacgcctctgctgcccagtacaaaagcgaacatgaccgtaagttgttatatacggcctgtacgcgggcgatgcatcatctgaccgtattgtctccgggagaaccctctccttttataaaagaagtgcccgccggcttattcgtgtaagccctttgccaagtgcaaagggctttttatcattagtaatcttaatcattgtcatcatgattatatattttacttacatacaaactttcggtaaagtttcaattagaatattattttgacaattcctatagaaataacgtacgttacgtttaattccttgtgaggtggatatcgttgcaacttcaggtcatgaacagtccgtttaatcaggagcaggcagagctccttaaccgccttctgccgaccttgacagaatcacagaaaatctggctgagcggttatttggctgctgcccggtccgaatccggtgaaacagccgcacccgctgctcaggctccagcagaaagcccggcagtctcaagagaagtgaccgtattatacggatcgcaaacgggaaatgcggaaggtcttgcgaaacagacggtaaagacgcttgaggaacggggattccaggtcaccgtcgcgtcgatgaacgattttaagccgaataatctgaaaaaagtaaacaatttactgatcgtggtgagcacgcacggagaaggcgatccgccggataacgcgctggcctttcatgaatttcttcacggcagacgcgcgccgaagcttgaagcgctccgttattccgttttggcgctcggggacagctcgtatgaatttttctgccagaccgggaaagagtttgacgagcgtcttcaagagctcggcggcacccagcttgcgccgcgggttgattgcgatcttgattatgatgagccgttttcggaatggcttgacgcggtcatcggcggtttgaatgaaggagcgggaaatcaaacagccgaagcgcctgccgagacgccggctctcggtgaatccgtttattccagaacgaatccgtttcgggcggaggttcttgagaacatcaatctgaacggacgcggttcgaataaagaaacacgccatctcgagctttcgcttgaaggatcgggcctcgcgtatcagcccggagacagcctcggcatctatccggaaaatgatccggcgctcgttgatgagctgatcaatgagctgaaatgggacccgaaacaggaagtggcggtgaataaacaaggagagcgcctcccgctgaaagatgcgcttacttctcattttgaaataaccgtcttaacaaaaccgttcctgcaaaaggccgcacagtttacggctgaccaaaagctgagtgaacttctggccgaaggaaacgaagagcagttgaaagcatacatcaacggccgtgatctgcttgatctcgtccgggatttcggtccgtgggaagcttccgcggaagactttctttccatcctgcgtaaaatgccggcccggctctattcgatcgcaagcagtttagaagcgaatccggaagaggtgcatctgacaatcggagcggtcagatatgacgcgcacggcagagaacgaaaaggcgtctgcagcattctgtgtgcggaaagacttcagccgggagatacgcttccgatttacattcagcacaaccaaaacttcaagctgccggaaaatccagatacaccggtcattatggtcgggccggggacaggcatcgcgccgttccgttcctttatgcaggagcgtgaagaaaccggagctgaggggaaaacatggctgtttttcggggatcagcactttgtcactgattttctgtaccagacggaatggcaaaaatggctgcaaaacggtgttctcacaaaaatggacgtcgctttttctcgggattcggaggaaaaggtatatgtgcagcaccgcatgaaagaacaaagcaaagagctgtatgaatggctgcagcagggagccgccgtatacatctgcggtgatgaacagcatatggcgcatgacgtgcaccaggcgcttctcgatatcattcaggaagaaggcggcatgagccgtgaaaaagcggaaagcttcctggcagacatgcagcagaaaaaacgctatcagcgtgacgtatattgattttggtttgaaaggagcttattcagcatggtgaacaacattttaaaagcgccggaaggccctccaagtgatgttgaggaaattaaagaaaaaagcgattatttgcgcggcacattgaaagaagtcatgctcgaccggatttcagccggcatcccggacgaagacaaccggctgatgaagcatcacggaagctacttgcaggatgaccgcgatctccgtaatgagcgtcaaaaacaaaagcttgaaccggcttatcagttcatgctgcgcgttcggatgccaggcggcgtttcaactccggaacaatggcttgtcatggatgaactggcgcaaaaatacggaaacaatacattgaagctgacaacgcgtgaaacgttccaaatgcacggaattttaaaatggaacatgaaaaaaacgattcagaaaatcaatgcggcgctgcttgataccattgcggcctgcggagatgtcaaccgaaacgtcatgtgcgcttcaaatccgtaccagtctgaaattcatgcggaagtatacgaatggtcgaagaaattgagcgatgaccttcttccgcgcacgagagcctatcatgaaatctggcttgatgaggaacgtgtggcgggcactcctgacacggaaacggaaccgatgtacgggccgctgtacctgccgcggaaattcaaaatcggaatcgccgtgcctccgtccaatgatatcgatgtcttttctcaagatctcggcttcattgccatcgtggaggaaggccgtcttatcggattcaacgtggcaatcggcggcggtatgggaatgacgcacggcgatacggccacttatccgcagctttcaaaagtcatcggcttctgcaaaccggagcagctgtatgatgtagcggaaaaaaccattacgattcagcgcgattacggaaaccgttccgtcagaaagaatgccagattcaagtacaccgttgaccgtctcgggctggaaaacgtaaaagccgagctggaaaaccgcctcggctggcagctggatgaagcgaaaccttatcattttgaccataacggcgaccgttacggatgggtgaagggtgtaaaagggaaatggcactttacaatgtttatcgaaggcggccgcgtcacggactatgagaattacaagctgatgacgggattgcgtgaaatcgccaaagtccatacgggagatttccgtctcacctctaatcaaaacctgattatcggcaatgtctcgagccagaaaaagaaacaaatcagcgcattaatcgaacaatacggtctgacagacggccggcagcattccgccctccgccgcagttcaatggcttgcgtcgcgcttccgacatgcgggctcgccatggccgaagccgagcggtatctgccgaaattgattgataagattgaagacattgttgacgaaaacgggctgcgggatgaagaaatcaccatccgtatgaccgggtgcccgaatggctgcgcccgccatgcgctcggcgaaatcggatttatcggaaaggcgcccggaaaatataatatgtatttaggagcggcgtttgacggcagccgtttgagcaaaatgtaccgggaaaatatcggtgaagaggaaattctgagtgagcttcgcaccattctcccgcgctacgcgaaagagcgtgaggaaggcgaacacttcggcgatttcgtcatccgcgccggcatcattaaagcgacgacagacggcacaaattttcacgaataagatgagcacttaaaaccaaggatagagacacactgacggtgcgttctctatcctttactaagcagcataagcgctgcaccgcgtcatgaaacagatgacgatgcttgcgaaaaagcctgttttcagagaaaacaggctttttctttttccggaaaaaatgtagctgaaggcaaaaaaagttcgccgtgagcacgttatgagaaattttaaataaaaacgggtaaaataaaagaagaatggttgcgtacggaaaatatattgaatctgcccgatcatcggctccggcctttggcaaaggcagagaacaggcaataatgatatgatgcagcagatgaaggaggtcatgctttggacatatttttagtcgtactcgtacttttaaccatcatcgcgatctcaaatatcgtaaatcggtttgtcccctttatcccggtgcctctgattcaggtggcgctcggtatcattgcggcgtcatttccgcaggggcttcattttgaactgaataccgaattgttttttgttttgtttatcgctccgctgctttttaacgatggaaaacggacgccgcgtgcggaactttggaatttaagggcgccgattctgctgcttgcgctcgggcttgtgtttgccacggtgattgtcggcggttacacgattcattggatgattccgagcattccgctggctgccgcgttcgggctggcggcgatactctcaccgactgacgttgtcgcggtcagcgcgctgtcagggcgagtgaagatgccaaaaggcattctgcgtctccttgaaggagaaggactgatgaatgacgcatccggcctggtcgcttttaaatttgcgattgcggctgccgtgacgggcgcattttcgctggcgcaggccgccttcagtttcgttctgatttcagccggaggtttactcagcggtgtcgtcatttcttttttgattatccgtttccggctgtttttgcgccgcctcggcatgcaggatgtcacgatgcatatgctgattcaaattctgacgccgttcgtcatctatctcgctgctgaagaaatcggcgtttccggcattttagcggttgtggccggcggcatcacgcatgcggtggagcaggaccgtcttgaatcaacgatggtcaaactgcaaatcgtctcttcaagtacgtggaatattattttgttcattctgaacggtcttgttttcgttattttaggtgcgcaaataccggatgtggtttctgtcatctttaatgataccgcgtttaacaatatgatggtcatcgggtacattatcgtcattacgctgacgttaatgattctcaggtttttgtgggtgctgtttttttggaacggcaagtggttttttaacaaggatcagagcatttataaacccggcctgcgctcgaccctgctgatttcggtttcaggcgtcaggggagcggttacgcttgcgggttccttttccattccgtacgtgctctctgacggctcgccgtttcctgaacggaatttgattctctttttagccgcgggcgttattatgtgcacattggtgctggcgacaatcgtactgccgattttgacagataagccggaagacaatgtgaaagagaagaaagtcaaattgctgacagcgagacggaagctgataaaagctgccttaaccgccattaaagaaaatatgaatgagacaaacaaaacggcttcttttgcggtcattgccgaatacaatgagaaaatgaaaaatctcaggtttcagcagttcacagtcaaaaaccgcacgaaaaaagatgagcggaaagtccgcgcccaagggatacaggctgaacaggaagaattgctgcggctgattgagcggggcgacataccggaagaaacggctgacagccttcaggaacggtttgatgaactggaagtgctgtatacgaatccgtttaaagtcggcttatctaagaaaaagctgaaacgcctgatgtactggatctttttcggtgaacaaaaaaagccggaaatgtcgattttaaatgaagaaggcctcatccgcaccacgagggttaaaacggcaaaagcggccattgaaagcctgaaaaaacacatgactgaagaaaataaagatgtgacgcttgccgtcatttccttttacaatcacttgattttcaggctggggcactcgtatcacgaacagagtccgagccgccgttttgaaaatcaaaaacttgaaatcaaactgcgggccgttcaggccatccgcaacgaaatccaaacattattcgaagagcgggaaatttcccgcgacatgtcgcatgagcttcgccaatacatcaatgatgtggaagcggccatgcttgacggagatgaataaaaaaagtccggcatctgttcgccggacttttttagattacggacgatggaattcgacgtgatcgccgtcgcggtcaaaccagcctctgaaggcccagttgatccagccgccatctcctttgttggtgaagcttccgtcttcaaacacccaaatgccgtacgtgatgccgtcataaacggcggaaccgtaaaactgaacgccgttaaaatgatcttcatattcctggcttaaattaaacaccatgacattatatttttgtccggaagcgtagaatgaagattccattaagtttttgacgaagccgtcacggttttgcgccgacttaatcgcgtcagcaatcgaattgccgatgccgagcaggtcaacgtcaatgtttaatccgacatcttttgctgagacatctgatgattgctgtgccatgttttgagggaccggggtttctttagcggatacaaaggacagaggagtcagagacaaagcggcgccaagggcaacggtcatcgggatacgcatacgtttcatatgatttcctccttcaattgtgtggtggctacagtagcgatttacccggacagttacccggttaaccggaatttttgaaaaataggaaaataataacgtcagtggtgcttgggcactaaagatggtttttgtgataacgatgagcgtataattggtttcttacggcggaaatgtgagataataataaccgtttacataatgactagaaaggatggttcaacgtggcaaaaagcttaaaagatactgtaaagcttcataatggcgttgaaatgccgtggttcggccttggcgtcttcaaggtggaaaacggaagcgtagcggcggactccgtcgaagcggcaatcagaaacggctaccgcagcattgatacggcggctatttataaaaatgaagagggtgtcggcgaaggcatcagagctgcgggcgttgccagagaagagctgttcatcacgtcaaaagtgtggaatgaagatcaaggatacgaaacgacacttgacgcgtttgagaaaagccttgagcgcctcggcctcgattacctcgacctttacctgattcactggccgggcaaggataaatataaagacacatggcgcgctcttgaaaagctgtacaaagacggcaaaatccgcgccatcggcgtcagcaacttccaagtgcatcatttagaagagctgctgaaagatgctgaaatcaagccgatggtcaaccagattgaattccacccgcgcctgactcaaaaagaagtaagagatttctgcaaagcgcagggcattcaagtggaagcatggtctccattgatgcagggacagctcctcgataacgaagtgctgtcacaaattgcggaaaaacataacaaatcagttgctcaagtgattttgcgctgggatcttcaaaacgaagtcgttaccattccgaaatccattaaagagcaccgcatcatagaaaatgccgatatttttgatttcgaactgtcacaggaagaaatggaaaagatcagcgcattgaacaaagacgagcgtgtcggcccgaatccggacgagcttctgttctaagaaaaaacagccctttacggggctgtttttctttacataaatgtctgtgtctgacgttttacgctgaacctgtatgcggctattaataacagggcggcggcgaaggctcccaaaatgatgatgttcagcatcaggctttggagcgtgcggccgtgctgcaattgatcgaccgtatcgagcacccagcgctgaggcagaaattcggcgattgtctgcaccgttttcggcataatattgctcggaaagaagcagccggcgagcaagcatgtcggcacgacgatcaaattcaaaagcgccgatgttgaagcgctgctgttggaaaaaccgacggcaataaaggcgatcccgatcgcgcttaatgcaaacagcatcatcaggacgaacagctgccacagcgggaatgacggatgaatatgaaaagcggcgcccataaagagaacggcgaatagaatttggacggccatgataatgatattcaccgccgcgtttgccagtacatactgctttgatgtgatcggcgttgacagaagcctgtagtacgtcctgttttcccgctctttaatcatcagttccgtcaggttgccggcggaatagagcataatgataatgagatacccgatgactgagtaggtcatttctttatattcgatgtatcttgtaaaacagcggactccgtttgaatcggagaatgcttgaaagcggcgtacatcgcctgaaaggctttcgcgtctccgccggaagatttgccgattgaggcggcgctgttcatataattgtacaaataagagctgacatatccggtgacctgggcgcctttcagcgaggtcatgccgatgtgagccggtttcccgtcttttacgctttgggagaagcctttttcaaacgtaatgagcgcctccatttttcctgaagcgatcttggatgtggcggacgcagccgtttcctccgaaatcttcacatgatccagtccttttaaaaacgtgaccgtatcctgtgccacttctccgccgtcctgattgagaatgccgatattgagcgtttcggctccgccgttggcattggtcatgaaggagaggaagacgccgatcagcggagccccgatataaagaataagctgttttttgctttttgtaatccctttgagagtgtgtgcaaacagccaccagaagtttttcatattacaatccctcccgtctttgaaacgtaaatgcggcgatcagcaaaaagagtgccgccaatgctgtatttaaaccgagtgcaggccatgccgctgatacatcatttgcgtaaatgatgctgttaatcgccttattgatccatgataagggcgacaggacggaaattcctccgccttcatatttgtaataggcgccgccgataatggacatcacctgaacgatgatgacggtgattaatctggcgctttcgggttttctggtcaaatagctcaggctgagcccgaagctgacggccaaaagaatttcagaaacgagaatcaaaagcacaaggcccatgtggctgccccaattcgcttttaagataaatttgctgaaggcgacaacggcaagaatcgtcagaacattcacagccaaaatgccgagcatctttccgagaaagatatcgcttttccggagcggagcggcgatcaggcgatccgcggtgtgccgtattctttccccgcggaataaggtgcttgcaaaaatcgaggcgtacagcccgatcatcgtcgtcatggatatcgcgtaaaaatctttcgctttcggttctttcgctttgtgtaaagacgtctgcttcatataatcgcttttgatttgtccggcggaaggcgccttatgcgccttgtaagcggcggcgcctgctttgtattgattggtaaaagcggtcagcatgccttggacgatcgtgccgtttatgccgctccggtcatttgtatagacttgaaaaccggtgttttttacagtgacgaaagcatccgcctgattttctcgaacctcgtttttgccttttgcctccgtgtccgctttttgaaaatagacatgctcttttttggcggctttcataaactcagtaaaataatgagaaagagggccgtttgactggtccgtatatacgaccttgatgtttccgaccgtcacctctgaatcaaaggcgtttgataatgccgcggtaaaaatcagcatgaagacgatcggaaaagcaagcatgaaaataaaagtccgtctgtcgcggaaactgattttgatttctttcccggcgatgtgcagaatattcatttgcaatcctcctttcaatggggtcagtcgcgcaggcttctgcctgtcagcgtgagaaataccgtttctaagtcaggggcctgttcctgcaaggagcggatttcaattcctttgtccatgaagtaccggatcaggcggtttaaattgttgacccctgtgtcagagctgattttcacgctgttttcttccagtgcggcggctctgacgccgggcagctcctgaatatcgccgaggctgatgccgtttccgggtgaaagctcaatcacgacgtccttcgtgtcggtaatgatggaggtcagctgttcttttgtgccttctgcgatgactttcccgtggtcaatgatggcgatgcgcgtgcatatttcttcaacttcctccatgtagtggctcgtgtagatgatcgtgcagcccatttcattcagctttttcactgactgcagaatataatttcttgattgcgggtcaataccgaccgtcggttcatccatgatgatcagtttcggccggtgggcaagggcgcacgcgatattgagcctgcgcttcattccgccggaaaaatgcttcggcaaatatttgtgtttatcgctcaagccgacgaatgtcagggcttcctcgacccgttctctcagagccgctcctctcaggccgtacagcccggcgaagaacttcacattttcataggcgtttaattcttcgtaaatcgcgaggtcctgagggacgatgccgatattcattttcgttgctttgctatatttgaaaatatcttttccgagaaacagaatgtctccgcctgaaggttttaaaagacctgagatcatattgatcgtcgtgctttttccggctccgtttgcgccgagaaacccgaaaatctcaccttcttttacggcaagcgacatctggtcaacggcggcataatcaccgaatttcttactcagctgtttgagctccaaaatgttcatgtttccacctctatgtcttatgatgctcttattataaaaaaaagaatgaacggccgttagtgcagctgttcattcctttgacatgagaatcttcatatttttcacatgaaaacattcacttattcaaccggaagcaatgtcgtgacggaaaaaccggccgtgccgtcaaaaataacggttccgtgcaggacggccccccgttcttccataccgagcatgccgaggccttttttaaagcggacggcgccgtttccgttatctttcacttccgctttcacggctttattcagtacatggatatcaatgaaaatctgcgtggcatcggcgtatttcatcgcattggtcaaagcttcggttacgttttcctgaatgactctccaatgcatttgcgtcagcctgtccaaatcgccttgatgcgtaaacggaaccggcatcccgtttttggccgaaaattcatcaataaacgttcttaatctgtgaatgcccatttgttcagcgggcggtttcatatttttcagcgttatgcggatatcctctatgccctctttggaaatggtaatggcgttttggagcagttcagccgctttgtccggatgggagccgagcatccgcttcgccgcttccatctgaatgagcgcgccggtcatggaatggccgattttatcatggatggcttgggataatctgtttctttcctcgagtttgccggtgtactccgattgtttgatatattccgtgctgctgtgcagctgtttcgtcagtttttcaatgcttgagcgcatgatgtccgactgttcttcatatttcttcagccgattgccggaccgggcggccaaaacgaatatcgccagacagaacaaggtcatgacgatataagtcggaaggtcgccgtacgggataaataaaaacggcaaaaacacgagcaggcagaacacatagcggtgaaccggatattcggcaagaaccgcaaaaatggcgggcggcaaaagaaacagaaacgccggatggcctaaggcggaaagccaagcggtcaatgccagcgccatgagggtgatcccgcgcctccaaacgggcggcctgatcatgcagaccgcgatgcccaaagacagataaagcagcagaaacaagacggcgtacggcgtgtaagggcggtctgccgatacgaacaaaaaagccgtataaaaaatggcgatcagtctgctcatcagcatccaaaaatccataccgttcaacgcccgttatccaccttcccggtgatataaaaaatggcgatctgcgttctgtgctcaagccctgttttccctaaaatagatgaaatataattggccgtcgtcccttcagaaatgaaaagctgttttgaaatttccctgttcgacagtcctttcgcaataagcgacatgatgctgagctctctttcagtaaactggctttcatcaatctgatgcgcggcttcggccggccgtaaaaggctgtcttttattttatccagcacggtgtcctgaagaatgctgtgcccgttgaagacgcttttgatcgcatcgcgtatccgttccggttcggtattttttaataaatatcctttcgcgccgtttttaatcgcttctaaaatatactcatcgtcgtcaaatgtcgtcaggatcatcggcttcgtatccgtttcctccgcgatccgttttgcggcttcgacgccgttcatcaccggcatgcggacgtccaacaaggcgatatcgacgggattgtgtttacaatactctgccgcctccaggccgttttccaacgttgccgatacagtaaattcctcatatgtatgcaaaatgattttcattccttctctgatgaaagaattatcatccgcgataatgacattaatcttcatggccgcaccctttgtgtgttttttgtttcattatataccatccgattttaaatcaaaaagcctcccggcgaaaggtgcgcggaaggcggatcagtcaagcgggttttttcaattggatgaaaaacagcatcaggaaagaaatgatcacaatacagatcacccacacccaggcgagtgtttcattgccggagtccatcgcgacgtaaattgctgtcggcagcgtttgggtgacgccgggaatatttcccgcaaacattaaagtcgccccgaattcacctagcgcccttgcaatactgagaatgcttccggtcaagagggagggaaaggcaagcgggacggaaatacgggtgaacacctgccacctgccggctccgtctactttcgccgctccctcgatgtcggcatcaaccgcggcgaagcccgttttagcggactgatacataagcgggaaggcgacaatggccgaagcgatcaccgcggccgaccacgtgaaaatgacgggctggtgaaaaatccgctcaatcgcccggccgataaagctgtgtttcccgaaaatgataatgagaatgaagccgacaacggtaggaggaagaacgagcgggagcataaacagggtctccacagccgtttttccgggaaatcgcgctttcgccatccaggcgccggcaagcgtcccgagaatgatgacggcgaggcccgatgccaaagccacctcaaacgacagtacgacgggagtgaaaaactccgaagccgtaatgttacttggcagtaaatccatatttcttaaacactttcatcgcttcatcagactgcagatactgataaaacgcctctgcttctttacggtgctttgtatccttgacgatgccgagcggatacacgatcggatcgtgcgttttcgccggcgcttcatcggtgattttcacctttttcgaaatcagtgcgtctgttttatagacaagcccggcatcgacatttccggtttcaacataagaaagcacctggcgaacgtcttttgcatagacgactttatcttttaccttgccccacagggataatgccgtcaatgactgtttggcgtattgtccggccggaacggattcaggcgtgccgagcgcgattttttccgcgctgtcttttttcaggtcattcagatgtgtcaggtgtgcgctgtttttctcaggcacgatcatgacgagatcatttttcaaaagatccgtgctgtcctttttatcgatatctccgtcatgaacgagcttttcgaatttatcttcggctgccgagaagaataaatcagctcccgcgccttgtgaaatttgtttctgcaatgtgcctgatgatccgaagttgtcttgaatggttacgtttgaatgtgatttttcgtagttggtctggatttcttcaagtgcatcctgagcgctggctgccgcagaaacggtcagcgtgactttttcgttttgtccgcctttggacgattgtccggatgagcagcccgcagttgcgaggaaaacggccatagccgcagttgtgagtagtgtcgctttctttttcaacattgtgcaccccttatagctagatatcattagatcaaactaattataacgcaattgtacgtaatggtgcggttttttttcaatatctgaacagttataataaaaatggagcgtgataatatgacagaagccacttcctatacaatagaagaagttgcgggccttttgaaggtctcaaaactgacagtatatgatttgataaaaaaaggactcattccggcgtacagggtcggaagacagatgagggtcgatgaagaggacttaaaacaatataaaacaaacatgagaatgtcaaaaaagccatccgtatcagaagctgctgacccgtcccgcgggcgggagccggaaaaaaggcagtccgttatcatcagcgggcaggatgtgtcgatggacctcctcagcaaacagctggaacaaacaatacaggcggccccgctccgcaagtacagcggcagtttgaacagcctgatcgagatgtaccgcggggcttgtaacatcgtcagtctgcatttatacgatggggagacggggcagtataacatcccgtacgtgaagcgcattctttcaggggagccgtttgcgctttttcatgtcgtgctgcggcaggccggattatatgtgaaaaagggcaatccgctgaacattcagggctttcaggacttgagccgaaaggatgtccgtatcgtcaatcgcgaaaaaggatcaggcgcgagggtgctgctggatgaacagctcagatctttcggtattacgccgtctgatgtcgccggctaccatgacattgtcacggatcatctgtcagcggcttcacaagtatcaagcggaaaggcggatatcggagtcgggtcgcagcatgcggcgcatatggcaggcacggactttatcccggtgatcagtgaacagtacgatgtggtcgtcttaaaacaaaaccgggagcttgttcaaagcgtgcaggacatcctcaattctgaggaattcaagtctcagctttctcaattatccggatatgatacgaaaatgaccggacggctcatatatgaaacatgaaaaatccctccatataacggagggatttttttattgcttgtaaaaccgcagcaggtcgccgtttaatattttatcggaaagcatcagctcttgttccgctttttctttctcatcgctgcacgcgctcatgtcagaaagcggttcacccgttttacggctgtaacacgtatttttcgtataaatatgatcatccgtgataaagctgccgtttctcagcaccgcaaacggggtccgctctccggaaaacagatcattgccgaactgaatgctgcctttcgtttcaatgccgagcaggtgaagcagcgtcggtcttacatcaacctgtcccgcggcggaagcaatcgtttccggcgcacggtcggtcaccccgggaatatgaatgataaacggcacgcgctgaagctgaaccgtatcaaacggagtgatttcctctttccctaagaattcggcaagtccttgattatgggcttcggatataccgtaatgatctcccatcaggacgatcatcgcgttgtcatacagtccttcttttttcagcttcttgaaaaagtgtttcagggcctcatcttcatcgcggaccgtcgtcacatagcggtttaataaatcgctgcttgtgtccggttcttcaatgagctgatcctgtttatcaatttcaaaaggaaaatggttggtcaaagtcagcaggctcgcgtaaaacggctgcggaagcttctttaatttttccgctgactgttcgagaaattccttatccttcaggccccagcctgttgaattttcctgtgtcaccttaaattcatccgcgtcgaaaaaacggtcgattccgaatgtcccgtacatctcatcccggttccaaaaggccttatgattggcatgcagaacggctgaatagtattgatgatcttttaacatatggtacatcgtattgaaccggtggccgctttttgtaaaaaaaacggcgccgctgaagacggatacagcgaattcgcagtaatgaattctgaatctgaggtttttccctgttcagtctgctgataaaaatgagtgaagtcataactttttttccgcagtttatttaaaaacggggtaatctcccgctcgttgacccgctcatccattacaaaacgctgggttgattcgagcgtaacaaaaatcacattgcgcccctttgccagcccgaactttgattcggacggcctgctgtagtcggcttgagtgtaatttgcgaccgccgcaaggctgtcttcgtcggcaaacgctttagcccctgcattcagcgtctgcgaaatggtgtcatacaaatgaaagtggaacaggccgattccttttacgagcgcttcacgatcaaaagggtgcttgaacagcttcggctgctcggcctcagacagcgcaaggttgcacagcatgaggccggctgatgcccacgcatacgctttaacggtacgggcgcccgtttttcctttaccggctttatgccttttaccaagataaaacaaaaccgcaatatccaaaaataaagcgatgtaaagcgggtgaaacagctcttggacgctgctccccatatcgcccatattgctcgcctgaaacaaaaccggtatggtgataaaatcaatataaaacccgtaaaacaccgtatttgcgattaaaatccccgtcagcatcacatttgccgaaagcagaaatatccgctgttttttttccgtcagcagcagggcgatgccgaacagcggcacaatgaagctcagcggattaatgagaagcagacattcctcaagaaccgaattgttctgcagatcaaaaccgagcttataaacggcataggttttcatccacatgaacaggatggacaggcataaaaaccgatgattgctgaaaaaggttttcttcatatgtatgactcctcaccctaaaagcgaaagatgctttttgtttatgagatgcggccgtgaaccagttcgtataaataatagcaggatacaatcgttaagccggccagcacaagctgctccgaaaagctccccgttctcatataaaggggaagacggaagcggatggcggacggaaacagcagtttaatgccgttgacggtccatgcgtcaagcacaaggtggctcgccattccgatcatcagtccggcggaaatgctcggattcggaatataggttgccgtaatgaaaaacataataagcataaacagcaggctgtgtgtaaacgttctgtggccgaacaccgtgcttacgattttggacagaacgggcagcgtcctgccgattttgcttttcgtatggcatatgtcgggaatcagcgccccgagggcacccgctgaggtcataaggaccggatcatacccgtaataatacgcaattgcggaacaagaagcgatgcctcccatgatgtgtgtttttcctgtcatttttcgcttctcctttttatttttgccaaaatcccctgaattacaaatatatcaagagaatgcatgtttgatcaacaaactttacctgttccgccaaaaggaaggagacgcggattccgcatattctgccgcggaaaaagacacattataggtgtacctatatttgataaagaggtgatacagatggctttctttaacaaagaaaaaggaaaaaacagcgataaaaacaaaaacgtcattcaaggcgcgcttgacgacgccggtgcagctctgaaagacgatccgcttcaagaagctgttcaaaagaaaaaaaacaaccgctgaccatataagacgggtagggcgaacgctctatccgttttccatctaatttttccctttgacagatctttttatctctgataacctctgagtagaattgaatgataaaaatcctcactctttctcggtgaggtagaggttgcgcttgatgatgagtcgcacatgccaggctgataggggccgcaaaacatgtgttaaaggcatcagcgccgaagtgtaaagaaagccgatccttctttatgctgggactgtatctgaataagtgcaggactgccgcgtgctttttcgcggagggctatccggagatcaagggtgtgtgtgtttctttaagcatggacttttgttcaggcttttttttgcgtgtaaatatggtctcggggtctggtccgtacgaatgaacaaccaggaggtacaggaatggaacagacgaaaaaatggggtttttggttattaacggcgtttgtcgtaggaaatatggtaggctcgggcatcttttcgcttccgagtacgctcgcaaaaatcgcgagcccgttcggcgctacatcggcatggcttttaacgggagccggtgtgttaatgatcgcgctggtcttcggccacttatccatccgcaagcctgagctgacggcggggccgcaaagctatgcgcgtgcgctgttcaatgatcggaaaaaagggaatgcagcgggcttcacgatggtgtggggctactgggtggcgagctggatcagcaacgtggcgatcatcacgagccttgccggatatttaacatcatttttcccgattttaacggataagcgtgaaatgttttcgatcggcggtcaggcggttacgctcggccagctgctgacgtttgccgtatgtacggttttattatggggcactcacacgattctcgtcaccagcattaacggtgcgagtaaattaaatttcgtcacgacgttttcaaaagtattaggatttatcttctttatcattgcaggtttatttgtgtttcaaacgtcgtttttcgatcatttttattttccggttcaaacaggtcctcacacagttgagggaatcggcgggcagatccacaatgcggcgatttcaacattatgggcgttcgtcggaattgaatctgcagtcatcttatccggacgcgcccgttcgcagcgcgacgtgaaacgcgccaccattaccggattattgatcgcgcttggcatctatatcatcgtgacattgattacgatgggcgtgcttccgcatggtaagcttgtcggctcggaaaaaccgtttgttgacgtattgtacgcgatcgtcggcaatgcgggaagcgtcatcatggcgattctggcgattttgtgtctgttcggaacgatgctcggctggattcttctcggttctgaagttccgtatcaagcggcgaaatcaggagactttcccgctgcttttgcaaaaacgaataaacagggaagcccggttgtgtcgttaatcgtaacgaacgtgatgtcacagatctttatcttttcggttatttcccggacgatcagtgacgcgtttacgtttttaacaacggcggcgacgcttgcttatctgattccgtatctcgtgtcagcgttttacagcctgaagctcatttttacgggtgaaacgtatgacgagataaagggctcaagagtaagagacggtatcatcgccatccttgcctgcatttattctttttacgtcattattaccggaacggccgatttaacgacctttattctcggtatcgggctgtttttcgtcggtttgctgttatatcctttcgtctcaaagaaatttgcaaacaacagacaatcggtatgacaaaaagacatctcacgtcagtgagatgtcttttttgtttgcggcagcgggttactttttgacggcgtgtatataatgaatggtctcgaatgcggttaaatggtcagtgcgtccgctgaaaaaacggtcattgacgtccgccggagataaatgttcataaataagcagacctgatgattctaatattttttcgatttctttataactgaaacacgataacatcggttctccgcttgctgcagccattttcaccatgttttccactctgtttgacagtcctctttcttcaaagagcgactcatctgcataatcaaacacgatagagcttcccggcgggacttcggcaaataattgtgtgagcaggcgggcgagatgctttttcgtaagatagtatgacacaccgagcaggctgaaaaaggttttttggactgaaaaaccttcctgatacagacggctgaaagaaagcgaagcggcgaagtccatcggtacaaaatgaagatgatgggaaatgccgaggttcagatgtttcaatctgtttattttgtcttcctgtgaagcgggatgatcgaattcaaatatgtctaaggcgtttgtcacctcaggatgcctgaaacaaaaagtatccagccccgcgccaaggatgacatactgtttggccccgagcttcacttcattgaaaagcacttcttcacaatatgcggcacgggctaacggtgtaggagacagctggacttgagtcacccattttaagatgtcatccggttggccttgaagcctctgggccatgtctttgctgaaaaatgatataccttgaatcagatgatcgcggatgtccgaatgctctttttcagaaatcagatcttgtgccaaaaaatcatcaaatatcactggggtgtcgtatttactgtggtacgcccttccgaaagcggacagcagggaagtcatactcgccttgttttctttcatataaagatcctccgttatttacatcaatctccggccgggagaatcttattatacatgttaatccaaaaatgtaaattatagcataaataaatttttttgtcaagttttaagcgtaataaaaagccgctgtcacagcggcttcggggttacttcgttaagctttttgtgatgtagtcgagctggccttcaagtgagatcgggtctgagaaatagaagccgatcggatcaatgcggtagacatggttttgtttgacggcatcgaggttcttccagattgagctgtcaagcacgcctttgtcgtcaccgccggcctgccatggccccataaagatgtagtctcccgcgaagtcaggcagtttctcgagtgaaatgctggcgtagcccggcccttgattaatggctttttcctgcgtcagttttgtggccttcagcccgagtttgtcataaatgatgcttccgccgcggccgaagtctttaccgaatacatagatgtcttttccgtttgtctgcatgatggagatggtttttgagccgaccgctttttgaacctttgttttagcggcagcggttttcttatcccattcagccagccatttgtctgctttatcttcagtgcctgtcattttcgcaaactctttgaattgatcaatgttgctgagcttgtcatatttaatggcgattgtcggcgcgattttttccagtttttcgatatcggcgccttgtgtcgtccagacaacgattaaatccggctttaagtcaatgattttttcaacggacgtgccgtcgccgatgtttgtcacaccttttgttttccctttgtaataagggtttttaaatacgttttgcggcgcgccgacaacattgatgccgagctgtttaaagtcgccgtagtagccgtcagccatgacgacgacccgtttcgggtgcttcggaattttaatattgccgttttcggctttatacgtgatggtttcttctttttcagaagaacctttcgtgtctgaagaattgccgcatgcggccaaagcggcgatgagcagcacggcaatcagcgctgcgccgattttcttgtatgtatggaacatctgacattccttctttcataaaaattagtgataaagagaatcattatcagtgtgattatatcactgctttcatagagaagcacgctctttttaaagaaaaactttctttttttatatgaaattaggtctattaaaagagaagataaaagtgctatactgaaacaagtcattgataatcattatcattaccattcttgttttgagaaaggaagaacgagtgttgggtctattgaaaaagaaacagacaatgacggctcaaggggcatcagggagtgaaatccagtggacggcgcgttcattccgggctgctgtgctgctgtgtgccggtattgcagttttattgatcggcgcggctctgtctgtttccatcggagctgccgatattcatctgcggacggtgtgggatgctctctttcactttcagccgcaaaatacatctcatcaaatcatacgcgatctgaggctgccgagaactgccgccgccgcgctcgtcggggcttttttagctgtgtccggggcgattatgcaggggctgacgcggaacccgcttgctgagccttccattatgggcgtgacgtcggggtcaggatttgcgatcgcattggcatttgctttttttccgggtctgtctgcggcgggacttgttttgtggtcctttgcgggagcgggaatcggagcgcttattgtgtttggcatcggcctgttttcaaaaggcggtctgacaccggtgaagctcgcgctggccggtacggcagtcggctatttcttaacggggctttcaagcgcgattgcgatccgttttgatgtcgcccaggatgtgaagttctggtatgccggaggagtcgcttccgtcaaatgggaaggcgtgcagctgcttttggcggccggtgttatcggactattgctggcatttctgattgcgcgctcagtgacggtgctgagcttgggtgaggaactggccaaagggctcgggcagtacacatcgcttgtaaaagtaatcggaatgtttgtcgttgtcctcttgacgggggcttcagtctcagtcgccggagccatttcttttatcggcttggtaattccgcatatcacccggtttttagtcggggtagattacaggtggatcattccctgttcggcggtattcggcgccgttctgttagtcttcagtgatattgccgcaagactcgtcaatgcgccgtttgaaacaccggtcggcgctttaaccgcccttatcggcgttccctttttcttttatttggcgcgcagggaaaggagagggctgtaatgaatgtaaaatcgaaaaaaccgctggcggtcatggccgttacgtttttgctcatatgcatcgtcttttttatcagtttaaacatgggggtgatccggattgcgcctcttgatacgctgcgtgtctttttcggacagggggatgcccgggatcagctcgttttatttgaattcagactgccgcgcatggtgctgtcattgctggtcggcgccggaatcgcggtttcaggcgcgatttttcaaagcgtgtctcaaaatgacttggcggagccgggcattctcggtattaacgccggagcgtctttggcggtcgttctgtttatcttctttttccaaggatcagctgttgatttaagcatggccggtacatggctgcttccggtgagcgctttggcgggggcttttctggctgcgctgctcatctatgttctggcttggaaaaaaggcgtttcacctgtccggctcgttttggtcgggatcggcgtcaatgcggggtttaatgcgcttctcttgatttttcagctgaaaatggacccgcgggatttcatgcaggcgcttgtatggatttccggttcgatttggaacgccaattggaaaatggtgctgtccattttgccgtggctgctggttcttttaccgttcagcctctataaagccaggtatttaaatgtgcttcagctcggtgatcagctggcggcggggcttggcacccgggttgaaaaggagcggcgcgttctgctgatgtccgccgttgccctgaccgcgtcatgtgttgcggcagccggcggaatcgcttttctcggactcattgcaccgcatttggccagaaggcttaccgggccgcgccaccagacgcttatcccggtttcggctttaatcggagcatttttatttctgcttgccgatacgctggcgagaaatgtgcttgcaccgtccgaaattcccgtcggcctggtgatttccgtgctcggagcgccgtattttgtatatttactgatgaaaacgaaatagaggaaggaggctgccgcgatgaactcattatcggcggaacagcttactgtcggttatggtgaccgtttgatagcgaaagaattggatatcgccatcccgaaaggaaaaattacaacgctgatcggtccgaacggctgcggaaaatcgacggttctcaaaacgatgtcaagaatcatgaaaccgaaatccggcgccgtctatttaaacggacaggcgatcatgcaaaaatccacgaaggacatcgccaaggaaatggcaattcttccgcagacgcctgaagcgccgagcgggctgacggtgtacgaacttgtttcttacggcaggtttccgcatcagtccggaatgggccgtttgagtgataaagaccgtgacatgatcaaatgggcgcttgaagagacggggatggccgaattttacgaccggccgatcgaagcgctttccgggggacagcggcagcgtgtgtggatcgccatggcgctcgctcaagaaacggagctgctgcttcttgatgaaccgaccacttatttagatctctcccatcagcttgaaattttgcagctgctggacaaattaaacaaggagcagggccgcaccattttaatggtcattcatgatctgaaccatgccgcccgtttttcccattacatgatcgccctgaaaaaagggcgcgtcatcaaggaaggaacggcggaggaagtcatgactcccggcatattggaagacgtgtttcaaattgacgcacagattgtaaaagatccgcgcacgaacaaaccggtctgcttaacctacgatttaatccggcatgaaaacgcaacggtaagatgaaaaaaaaacgcagagccattccggcctgcgttttttagtgcgcccggggctgcttttgtccggagacgcatttatccaaaacgaaaaaaactcccgccacaatcagctcctccgtcgttgacagccaaatcttttcaatcagtttatccgtcgtatacgcggtcatccagaggaacagcagctgaacggtgccggctaaaaggagaaaaggcagcctgcccgtcccaaaaaaggtaaagctatgtatcatcagccgctcaagcggttcaaaacataaaccgagaagaataaaaagcacggaaaaaagcaggacgtacgccatcgatccgtagctcgtcccggctaatgaaaatacagccatcatcacgataaaatacccgaataatacggcagcggctgccagggcataccggagcacctgaagaaaaaacattttcgtcccgttttgattgatcatctgttcagctccttttcacacagaggagacttgcagagacggaactctgcaagtcgatgtgtatcttcagcatttctttttgacgacagggtgtttctctttcgaaagaatatccgtaaagtctttgcccagatccagatgctgctggacgaatttctcgggaagcatggcaagccattggttcagggacacatcggcatagtggtcatccttgaagatttccaggaagacgagcggctcatctcccaaattttccacatagtggcccattgcgaacggaacgtaaccgacatccccggcctgatagttaaatgttcttgcatggccgtccgatgcaaaaaccgtcatccgccctttaccggaaatataatactgccattcatgcgtgttcggatgccagtgcagctctctcattgcgcccggttcgaccacgacaagcgctgaagcgatcgttttggacactttgaagtttgtggaatccgcgatatatactttgccgccatccgtctcagcagtcgggccttcatccagcaggcggtaagtgaacggatatggcacttcaccgttcgggccttccacaatgtcatctttcagcttcccgggaaccggctcttcaaagatatatttttctttcccgggcaggccggcgaggtctttttctgaaaccccgaagttgttggcgatgacatcaagcggtgtgtgggcaagccagtcagtcacttggaatgtgctgttttctgagaaggaaccgtcatcaaaaaccaagaggaattcacagccttctttcagcgcctgaatggagtgcggcaggcctgacgggaagtaccacagatctccttccttcacgtcatcgataaaactgcgtccctgttcatcaacaatcgtgacccgcgctttgcccgtcagcatatatgcccattccgcttctttatgccagtgcagctcacggatggcacccggttttaaacgcatgttgacagatgccagattttcagaaatcggcagctcgcgaacggtcacctcacgcgcgtatccgcccttttccagccggttgtgcacatctgagaaagagaatttcatattatccactgtgccgtgatccgtttccggcggcgtcagcatatccggattttggcggtctctttcaaggttgcgcggtatcgtgacggtcgcccctttgtctcctctgatcggctgcgggatattgcagttgttttcttttgacatgtaaatcgtctcctctcaagctttgttttttcagaaagagaatgtgaaaggcctttcgttttcccttctgctttgttaagtgatgcgttccgatgaaaagtcaacttcgagtgaaaattaatttttcattttctgctctttcagttccgtcatcagttcgatcagggcgtcaaacttcttctcaaaccgtgtgagaagatacatggcaatcagagccggaaagccgagattgccgatctgtctgaccgtttcttctataaaaacctgatccattatcagccacctcctgacttgacctgcagtcatgtatataagtgaaagaaagagcggctcctgtaaacctgatatcccggttgagggtcttttttttgttccggcaaaaccgggacataaggaatacggaatcttagtcggaaaggagtagtttacttttttttgctttctttcatttaatttaaatagggggcggttttatggactatcaagttcttttacggtcaaaatgcaaggaaattatgaaacatccgatcgttaaacattttttaagtgacccaaagcattacgagaaatttaaaaatgtgctggaacattcagacgagaaggatgcaaaatcattggatgaccattttaagcagttttataaggaaatccggatcatcaaatatatgaactctatgatccggattttctcaatcgattttgacaagcgcatccgtaaaaatcagaagcgctatccgctgacggtggatcagccggagggaggtgaagcgcttccctatgaaatgggaaaagacgcgtatgaagagtttctgcggaagcagggggatttgagccagcatgtccaaaaccgtgatttatacgaagcgcttcagacgttaaccgataagcaaaaaagcgtgctgacgaatatttatcttcacggagcgacgatgaaggagattgccgagtcgctgggtgaatcacggcagaacatttctaatattcataaaaaagggctcgataatctcagaaagcatctggacaagcaaaaaaagggggaaaataagcagtgaacgggccatttgacttcagcaaagagaacacagataccgacgaaatggaacttttgatttcgcgtttttcgccaatgataaaaaaaaactgagcaatacatcataccaggaaagagaagatcttgaacaagaattgaagattaaaatagttgaaaaagcggacatgctgttatgccaggacgtgccgggtttttgggaatttattcttcatcttataaatgaaagctcctgacaaaagcggcggaatgatggatattccgctctgacaacgtgagaaaaacgagaagagatgtccggtctcgtttttcttttctgtttccccgcaagacctccgcactaaaaaagtaccaaatcttatccatataatgatatgatgaaaaaaacaaagagaaaggaacgtccaagtggaaaatgcgtcaattttaattgtagacgatgagaaggcgatcgttgatatggtcaaacgcgttctcgtcaaagaaggctatcacaacattaagacagccggaagcgctgaggaagcgatcgagtttgttaaacatgaaaccgcggatctgctcgtgctggatgtgatgatggaaggcatgtccggttttgaagcatgcaccgaaatccggaactataccgacgctccgatcttttttctgactgcccgttcttctgatgcggataagctgtcaggatttgcattgggagctgacgattatataacaaagccgtttaatccgctcgaattggcggcgcggatcagggcgacgttaaagagaacctataagcgcgaagagaaaacggcggtaaagacgtattcatacagccatttttcctattcaccgcaaaacgccgagctgatcgtcgggggcgagcccgtcagctgctccgcacagcttctgcagctgcttcaatatttctgtgaacaccctgatgtggtgctctcaaaagatcagatctatgaaaaagtatggggatatccgtcttacggcgacaacaacaccgtcatggtgcatatccgcaagctcagagaaaaga
